US010508143B1

(12) United States Patent
Lobb et al.

(10) Patent No.: US 10,508,143 B1
(45) Date of Patent: Dec. 17, 2019

(54) COMPOSITIONS AND METHODS FOR TREATMENT OF CANCER

(71) Applicant: Aleta Biotherapeutics Inc., Natick, MA (US)

(72) Inventors: Roy Lobb, Wellesley, MA (US); Paul Rennert, Holliston, MA (US)

(73) Assignee: Aleta Biotherapeutics Inc., Natick, MA (US)

( * ) Notice: Subject to any disclaimer, the term of this patent is extended or adjusted under 35 U.S.C. 154(b) by 81 days.

(21) Appl. No.: 15/315,844

(22) PCT Filed: Oct. 28, 2016

(86) PCT No.: PCT/US2016/059582
§ 371 (c)(1),
(2) Date: Dec. 2, 2016

(87) PCT Pub. No.: WO2017/075537
PCT Pub. Date: May 4, 2017

Related U.S. Application Data

(60) Provisional application No. 62/396,783, filed on Sep. 19, 2016, provisional application No. 62/331,010, filed on May 3, 2016, provisional application No. 62/249,144, filed on Oct. 30, 2015.

(51) Int. Cl.
| | | |
|---|---|---|
| *A61K 39/00* | (2006.01) | |
| *A61K 35/17* | (2015.01) | |
| *C07K 14/725* | (2006.01) | |
| *C07K 16/28* | (2006.01) | |
| *C07K 16/32* | (2006.01) | |
| *A61P 35/00* | (2006.01) | |
| *A61K 39/395* | (2006.01) | |

(52) U.S. Cl.
CPC .......... *C07K 14/7051* (2013.01); *A61P 35/00* (2018.01); *C07K 16/2803* (2013.01); *C07K 16/2863* (2013.01); *C07K 16/32* (2013.01); *A61K 35/17* (2013.01); *A61K 39/39558* (2013.01); *A61K 2039/505* (2013.01); *C07K 2317/24* (2013.01); *C07K 2317/622* (2013.01); *C07K 2317/92* (2013.01); *C07K 2319/03* (2013.01); *C07K 2319/33* (2013.01)

(58) Field of Classification Search
CPC ........ A61K 35/17; A61K 38/00; A61K 39/00; A61K 2039/505; A61K 39/39558
See application file for complete search history.

(56) References Cited

U.S. PATENT DOCUMENTS

| | | |
|---|---|---|
| 5,807,715 A | 9/1998 | Morrison et al. |
| 5,994,136 A | 11/1999 | Naldini et al. |
| 6,165,782 A | 12/2000 | Naldini et al. |
| 6,326,193 B1 | 12/2001 | Liu et al. |
| 6,416,945 B1 | 7/2002 | McCarthy et al. |
| 6,428,953 B1 | 8/2002 | Naldini et al. |
| 6,599,739 B1 | 7/2003 | Lowy et al. |
| 7,205,126 B2 | 4/2007 | Qiao et al. |
| 8,394,411 B2 | 3/2013 | Roberts et al. |
| 8,470,528 B2 | 6/2013 | Pasqualini et al. |
| 8,513,390 B2 | 8/2013 | Stagliano et al. |
| 9,120,853 B2 | 9/2015 | Lowman et al. |
| 9,127,053 B2 | 9/2015 | West et al. |
| 2006/0205069 A1 | 9/2006 | June et al. |
| 2010/0189651 A1 | 7/2010 | Stagliano et al. |
| 2011/0070191 A1 | 3/2011 | Wong et al. |
| 2013/0089539 A1 | 4/2013 | Rennert et al. |
| 2013/0101555 A1 | 4/2013 | Stagliano et al. |
| 2014/0044712 A1* | 2/2014 | Hall .................... C07K 16/1214 424/134.1 |
| 2014/0045195 A1 | 2/2014 | Daugherty et al. |
| 2014/0099309 A1 | 4/2014 | Powell, Jr. et al. |
| 2014/0363430 A1 | 12/2014 | West et al. |
| 2015/0183875 A1 | 7/2015 | Cobbold et al. |
| 2015/0183881 A1 | 7/2015 | Bedi et al. |
| 2015/0307564 A1 | 10/2015 | Young et al. |
| 2017/0210811 A1* | 7/2017 | Wong ................. C07K 16/2863 |
| 2017/0260288 A1 | 9/2017 | Lobb et al. |
| 2017/0267756 A1* | 9/2017 | Riddell ................. A61K 35/17 |
| 2017/0335281 A1 | 11/2017 | Loew et al. |
| 2018/0009895 A1* | 1/2018 | Smith .................. C12N 5/0093 |
| 2018/0022821 A1 | 1/2018 | Lobb et al. |
| 2018/0142035 A1 | 5/2018 | Lobb et al. |
| 2018/0162939 A1* | 6/2018 | Ma ......................... A61K 35/17 |
| 2018/0236053 A1* | 8/2018 | Dusseaux .......... A61K 39/0011 |
| 2019/0112386 A1 | 4/2019 | Lobb et al. |

FOREIGN PATENT DOCUMENTS

| | | |
|---|---|---|
| EP | 1697421 B1 | 9/2010 |
| WO | WO-93/21232 A1 | 10/1993 |
| WO | WO-98/37186 A1 | 8/1998 |
| WO | WO-01/29058 A1 | 4/2001 |

(Continued)

OTHER PUBLICATIONS

Grada et al. (Mol Ther Nucleic Acids. Jul. 9, 2013; 2: e105; pp. 1-11).*
Ambrose et al. (Cancer Res. 2017; 77 (13 Suppl.): 3768; pp. 1).*
Ma et al. (Prostate. Sep. 15, 2004; 61 (1): 12-25).*
Benedict et al. (J. Immunol. Methods. Feb. 28, 1997; 201 (2): 223-31).*
Xie et al. (Mol. Immunol. Apr. 2010; 47 (7-8): 1529-34).*
Bhatt et al. (2016) Expression of Epitope-Tagged Proteins in Mammalian Cells in Culture. In: Schwartzbach et al. (eds.) High-Resolution Imaging of Cellular Proteins. Methods in Molecular Biology, vol. 1474. Humana Press, New York, NY; pp. 3-22.*
Ackerman, M. et al., Highly avid magnetic bead capture: an efficient selection method for de novo protein engineering utilizing yeast surface display, Biotechnol. Prog., 25:774-783 (2009).

(Continued)

*Primary Examiner* — Stephen L Rawlings
(74) *Attorney, Agent, or Firm* — Choate, Hall & Stewart LLP; Brenda Herschbach Jarrell; Rolando Medina

(57) ABSTRACT

Compositions, e.g., compositions comprising cellular therapeutics and/or protein therapeutics, and methods of using such compositions for treating cancer are described.

4 Claims, 95 Drawing Sheets

Specification includes a Sequence Listing.

(56) References Cited

FOREIGN PATENT DOCUMENTS

| | | |
|---|---|---|
| WO | WO-01/96584 A2 | 12/2001 |
| WO | WO-2010/027827 A2 | 3/2010 |
| WO | WO-2013/045125 A1 | 4/2013 |
| WO | WO-2013/163631 A2 | 10/2013 |
| WO | WO-2015/007542 A1 | 1/2015 |
| WO | WO-2015/057834 A1 | 4/2015 |
| WO | WO-2015/142661 A1 | 9/2015 |
| WO | WO-2015/142675 A2 | 9/2015 |
| WO | WO-2016/168773 A2 | 10/2016 |
| WO | WO-2017/075533 | 5/2017 |
| WO | WO-2017/075537 | 5/2017 |
| WO | WO-207155996 A1 * | 9/2017 |

OTHER PUBLICATIONS

Adler, M. and Dimitrov, D., Therapeutic antibodies against cancer. Hematol Oncol Clin North Am, 26(3):447-81 (2012).

Barbet, J. et al., Radiolabeled antibodies for cancer imaging and therapy, Methods Mol Biol, 907:681-97 (2012).

Bitter, G. et al., Expression and secretion vectors for yeast, Methods Enzymol, 153:516-44 (1987).

Boder, E. and Wittrup, K., Yeast surface display for screening combinatorial polypeptide libraries, Nat Biotechnol, 15:553-557 (1997).

Bouchard, H., Antibody-drug conjugates—a new wave of cancer drugs, Bioorg Med Chem Lett, 24(23):5357-63 (2014).

Browning, J. et al., Characterization of lymphotoxin-alpha beta complexes on the surface of mouse lymphocytes, J Immunol, 159(7):3288-98 (1997).

Byla, P. et al., Selection of a novel and highly specific tumor necrosis factor alpha (TNFalpha) antagonist: insight from the crystal structure of the antagonist-TNFalpha complex, J Biol Chem, 285(16):12096-100 (2010).

Castellanos, M. et al., Expression of the leukocyte early activation antigen CD69 is regulated by the transcription factor AP-1, J Immunol, 159(11):5463-73 (1997).

Chao, G. et al., Isolating and engineering human antibodies using yeast surface display, Nat Protoc, 1(2):755-68 (2006).

Chow, C. et al., Requirement for transcription factor NFAT in interleukin-2 expression, Mol Cell Biol, 19(3):2300-7 (1999).

Cull, M. et al., Screening for receptor ligands using large libraries of peptides linked to the C terminus of the lac repressor, Proc Natl Acad Sci USA, 89(5):1865-9 (1992).

Czerkinsky, C. et al., A Solid-Phase Enzyme-Linked Immunospot (ELISPOT) Assay for Enumeration of Specific Antibody-Secreting Cells, Journal of Immunological Methods, 65:109-21 (1983).

Decock, J. et al., Matrix metalloproteinases: protective roles in cancer, J Cell Mol Med, 15(6):1254-65 (2011).

Dreher, M. et al., Colony assays for antibody fragments expressed in bacteria, J Immunol Methods, 139(2):197-205 (1991).

Du, J. et al., Structural basis for recognition of CD20 by therapeutic antibody Rituximab, J Biol Chem, 282(20):15073-80 (2007).

Edwards, D. et al., The ADAM metalloproteinases, Mol Aspects Med, 29(5):258-89 (2008).

Eilers, M. et al., Chimaeras of myc oncoprotein and steroid receptors cause hormone-dependent transformation of cells, Nature, 340(6228):66-8 (1989).

Fuchs, P. et al., Targeting recombinant antibodies to the surface of Escherichia coli: fusion to a peptidoglycan associated lipoprotein, Biotechnology (NY), 9(12):1369-72 (1991).

Gibson, H. et al., Induction of the CTLA-4 gene in human lymphocytes is dependent on NFAT binding the proximal promoter, J Immunol, 179(6):3831-40 (2007).

Gill, S. and June, C., Going viral: chimeric antigen receptor T-cell therapy for hematological malignancies, Immunol Rev, 263(1):68-89 (2015).

Goldenberg, David M., Targeted therapy of cancer with radiolabeled antibodies, J Nucl Med, 43(5):693-713 (2002).

Goldstein, I. et al., alpha1beta1 Integrin+ and regulatory Foxp3+ T cells constitute two functionally distinct human CD4+ T cell subsets oppositely modulated by TNFalpha blockade, J Immunol, 178(1):201-10 (2007).

Grabherr, R. and Ernst, W., The baculovirus expression system as a tool for generating diversity by viral surface display, Comb Chem High Throughput Screen, 4(2):185-92 (2001).

Graham, F. et al., Characteristics of a human cell line transformed by DNA from human adenovirus type 5, J Gen Virol, 36(1):59-74 (1977).

Hackel, B. et al., Stability and CDR composition biases enrich binder functionality landscapes, J Mol Biol, 401(1):84-96 (2010).

Hillerdal, V. et al., Chimeric antigen receptor-engineered T cells for the treatment of metastatic prostate cancer, BioDrugs, 29(2):75-89 (2015).

International Search Report for PCT/US2016/059582, 4 pages (dated Jan. 27, 2017).

Kakarla, S., and Gottschalk, S., CAR T cells for solid tumors: armed and ready to go?, Cancer J, 20(2):151-5 (2014).

Kang, A.S. et al., Linkage of recognition and replication functions by assembling combinatorial antibody Fab libraries along phage surfaces, Proc Natl Acad Sci USA, 88:4363-4366 (1991).

Kontermann, R. and Brinkman, U., Bispecific antibodies. Drug Discov Today, 20(7):838-47 (2015).

Krämer, B. et al., Regulation of the human TNF promoter by the transcription factor Ets,. J Biol Chem, 270(12):6577-83 (1995).

La Rocca, G. et al., Zymographic detection and clinical correlations of MMP-2 and MMP-9 in breast cancer sera, Br J Cancer, 90(7):1414-21 (2004).

Leavy, O., T cells: LEM keeps the wheels turning, Nat Rev Immunol, 15(6):334 (2015).

Lebien, T. and Tedder, T., B lymphocytes: how they develop and function, Blood, 112(5):1570-80 (2008).

Li,G. et al., Monoclonal antibody-related drugs for cancer therapy, Drug Discov Ther, 7(5):178-84 (2013).

Logan, J. and Shenk, T., Adenovirus tripartite leader sequence enhances translation of mRNAs late after infection, Proc. Natl. Acad. Sci. USA, 81:3655-3659 (1984).

Magee, M. and Snook, A., Challenges to chimeric antigen receptor (CAR)-T cell therapy for cancer, Discov Med, 18(100):265-71 (2014).

Mather, J. et al., Culture of testicular cells in hormone-supplemented serum-free medium, Ann N Y Acad Sci, 383:44-68 (1982).

Mather, J., Establishment and characterization of two distinct mouse testicular epithelial cell lines, Biol Reprod, 23(1):243-52 (1980).

Mcatee, C. et al., Emerging roles for hyaluronidase in cancer metastasis and therapy, Adv Cancer Res, 123:1-34 (2014).

Natarajan, A. et al., A novel engineered anti-CD20 tracer enables early time PET imaging in a humanized transgenic mouse model of B-cell non-Hodgkins lymphoma, Clin Cancer Res, 19(24):6820-9 (2013).

Nicholson, I. et al., Construction and characterisation of a functional CD19 specific single chain Fv fragment for immunotherapy of B lineage leukaemia and lymphoma, Mol Immunol, 34(16-17):1157-65 (1997).

Polu, K. and Lowman, H., Probody therapeutics for targeting antibodies to diseased tissue, Expert Opinion on Biological Therapy, 14(8):1049-1053 (2014).

Roberts, R. and Szostak, J., RNA-peptide fusions for the in vitro selection of peptides and proteins, Proc Natl Acad Sci USA, 94(23):12297-302 (1997).

Rüther, U. and Müller-Hill, B., Easy identification of cDNA clones, The EMBO Journal, 2(10):1791-1794 (1983).

Sadelain, M. et al., The Basic Principles of Chimeric Antigen Receptor Design, Cancer Discovery, 3(4):388-398 (2013).

Sandersjöö, L. et al., A new prodrug form of Affibody molecules (pro-Affibody) is selectively activated by cancer-associated proteases, Cell Mol Life Sci, 72(7):1405-15 (2015).

Sareneva, T. et al., Kinetics of cytokine and NFAT gene expression in human interleukin-2-dependent T lymphoblasts stimulated via T-cell receptor, Immunology, 93(3):350-7 (1998).

Sassoon, I. and Blanc, V., Antibody-drug conjugate (ADC) clinical pipeline: a review, Methods Mol Biol, 1045:1-27 (2013).

(56) References Cited

OTHER PUBLICATIONS

Schaffitzel, C. et al., Ribosome display: an in vitro method for selection and evolution of antibodies from libraries, J Immunol Methods, 231(1-2):119-35 (1999).
Schlessinger, Joseph, Cell signaling by receptor tyrosine kinases, Cell, 103(2):211-25 (2000).
Schröter, C. et al., A generic approach to engineer antibody pH-switches using combinatorial histidine scanning libraries and yeast display, Mabs, 7(1):138-51 (2015).
Scott, A. et al., Monoclonal antibodies in cancer therapy, Cancer Immun, 12:14 (2012).
Sliwkowski, M. and Mellman, I., Antibody therapeutics in cancer, Science, 341(6151):1192-8 (2013).
Smith-Garvin, J. et al., T cell activation, Annu Rev Immunol, 27:591-619 (2009).
Spiess, C. et al., Alternative molecular formats and therapeutic applications for bispecific antibodies, Mol Immunol, 67(2 Pt A):95-106 (2015).
Stanton, H. et al., Proteoglycan degradation by the ADAMTS family of proteinases, Biochim Biophys Acta, 1812(12):1616-29 (2011).
Stauss, H. et al., Cancer gene therapy with T cell receptors and chimeric antigen receptors, Curr Opin Pharmacol, 24:113-8 (2015).
Steiner, M. and Neri, D., Antibody-radionuclide conjugates for cancer therapy: historical considerations and new trends, Clin Cancer Res, 17(20):6406-16 (2011).
Tan, G. et al., Cathepsins mediate tumor metastasis, World J Biol Chem, 4(4):91-101 (2013).
Tedder, TF., CD19: a promising B cell target for rheumatoid arthritis, Nat Rev Rheumatol, 5(10):572-7 (2009).
Tey, Siok-Keen, Adoptive T-cell therapy: adverse events and safety switches, Clin Transl Immunology, 3(6):e17 (2014).
Tsytsykova, A. et al., The CD40L promoter contains nuclear factor of activated T cells-binding motifs which require AP-1 binding for activation of transcription, J Biol Chem, 271(7):3763-70 (1996).
Urlaub, G. et al., Isolation of Chinese hamster cell mutants deficient in dihydrofolate reductase activity, Proc Natl Acad Sci USA, 77(7):4216-20 (1980).
Van Heeke, G., and Schuster, S., Expression of human asparagine synthetase in *Escherichia coli*, J Biol Chem, 264(10):5503-9 (1989).
Wadleigh, M. et al., After chronic myelogenous leukemia: tyrosine kinase inhibitors in other hematologic malignancies, Blood, 105(1):22-30 (2005).
Wang, K., et al., CD19: a biomarker for B cell development, lymphoma diagnosis and therapy, Exp Hematol Oncol, 1(1):36, 7 pages (2012).
Woldring, D. et al., High-Throughput Ligand Discovery Reveals a Sitewise Gradient of Diversity in Broadly Evolved Hydrophilic Fibronectin Domains, PLoS One, 0(9):e0138956 (2015).
Written Opinion for PCT/US2016/059582, 20 pages (dated Jan. 27, 2017).
Wu, E. et al,. Comprehensive dissection of PDGF-PDGFR signaling pathways in PDGFR genetically defined cells, PLoS One, 3(11):e3794 (2008).
Yang, J. et al., Platelet-derived growth factor mediates survival of leukemic large granular lymphocytes via an autocrine regulatory pathway, Blood, 115(1):51-60 (2010).
Zhao, Y. et al., A herceptin-based chimeric antigen receptor with modified signaling domains leads to enhanced survival of transduced T lymphocytes and antitumor activity, J Immunol, 183(9):5563-74 (2009).
Baas, Tracey, Keys to the CAR, SciBX: Science-Business eXchange, 7 pages (2014).
Biragyn, A. et al., Genetic fusion of chemokines to a self tumor antigen induces protective, T-cell dependent antitumor immunity, Nature Biotechnology, 17:253-258 (1999).
Buck, CB and Thompson, CD, Production of papillomavirus-based gene transfer vectors, Curr Protoc Cell Biol, Chapter 26:Unit 26.1 (2007).

Colombo, M. and Trinchieri, G., Interleukin-12 in anti-tumor immunity and immunotherapy, Cytokine Growth Factor Rev, 13(2):155-68 (2002).
Conlon, K. et al., Redistribution, hyperproliferation, activation of natural killer cells and CD8 T cells, and cytokine production during first-in-human clinical trial of recombinant human interleukin-15 in patients with cancer, J Clin Oncol, 33(1):74-82 (2015).
Dong, W. et al., ORCA-010, a Novel Potency-Enhanced Oncolytic Adenovirus, Exerts Strong Antitumor Activity in Preclinical Models, Humane Gene Therapy, 25:897-904 (2014).
Gevaert, K. and Vandekerckhove, J., Protein identification methods in proteomics, Electrophoresis, 21(6):1145-54 (2000).
Guthals, A. et al., Shotgun protein sequencing with meta-contig assembly, Mol Cell Proteomics, 11(10):1084-96 (2012).
Hajitou, A. et al., A Hybrid Vector for Ligand-Directed Tumor Targeting and Molecular Imaging, Cell, 125:385-398 (2006).
Hung, C. et al., Ovarian cancer gene therapy using HPV-16 pseudovirion carrying the HSV-tk gene, PLoS One, 7(7):e40983 (2012).
International Search Report for PCT/US2016/059578 (Compositions and Methods for Tumor Transduction, filed Oct. 28, 2016), issued by ISA/US, 4 pages (dated Jan. 30, 2017).
Kines, R. et al., Human papillomavirus capsids preferentially bind and infect tumor cells, International Journal of Cancer, 138:901-911 (2016).
Kontermann, R., Dual targeting strategies with bispecific antibodies, Mabs, 4(2):182-197 (2012).
Leonard, J. et al., Effects of single-dose interleukin-12 exposure on interleukin-12-associated toxicity and interferon-gamma production, Blood, 90(7):2541-8 (1997).
Papadakis, E. et al., Promoters and control elements: designing expression cassettes for gene therapy, Curr Gene Ther, 4(1):89-113 (2004).
Sorensen, E. et al., IL-12 Suppresses Vascular Endothelial Growth Factor Receptor 3 Expression on Tumor Vessels by Two Distinct IFN-γ-Dependent Mechanisms, J. Immunol, 184:1858-1866 (2010).
Sun, M. et al., Construction and evaluation of a novel humanized HER2-specific chimeric receptor, Breast Cancer Research, 16(R61):10 pages (2014).
Tugues, S., et al., New insights into IL-12-mediated tumor suppression, Cell Death Differ, 22(2):237-46 (2015).
Written Opinion for PCT/US2016/059578 (Compositions and Methods for Tumor Transduction, filed Oct. 28, 2016), issued by ISA/US, 8 pages (dated Jan. 30, 2017).
Yu, F. et al., T-cell Engager-armed Oncolytic Vaccinia Virus Significantly Enhances Antitumor Therapy, Molecular Therapy, 22(1):102-111 (2013).
Nadler, Lee M., B Cell/Leukemia Panel Workshop: Summary and Comments, Leukocyte Typing II, Springer-Verlag New York Inc., 3 pages (1986).
Nicholson, I. et al., Construction and Characterisation of a Functional CD19 Specific Single Chain Fv Fragment for Immunotherapy of B Lineage Leukemia and Lymphoma, Molecular Immunology, 34(16-17):1157-1165 (1997).
Zola, H. et al., Preparation and characterization of a chimeric CD19 monoclonal antibody, Immunology and Cell Biology, 69:411-422 (1991).
Cartellieri, M., et al., Switching CAR T cells on and off: a novel modular platform for retargeting of T cells to AML blasts, Blood Cancer Journal, 6:e458, 8 pages (2016).
Gerstmayer, B. et al., Costimulation of T Cell Proliferation by a Chimeric B7-2 Antibody Fusion Protein Specifically Targeted to Cells Expressing the erbB2 Proto-Oncogene, The Journal of Immunology, 158:4584-4590 (1997).
Gillies, S. et al., Bi-functional cytokine fusion proteins for gene therapy and antibody-targeted treatment of cancer,, Cancer Immunol Immunother., 51:449-460 (2002).
Kim, E. et al., Interleukin-2 fusion protein with anti-CD3 single-chain Fv (sFv) selectively protects T cells from dexamethasone-induced apoptosis, Vaccine, 20:608-615 (2002).

(56) References Cited

OTHER PUBLICATIONS

Chmielewski, M. et al., Of Cars and Trucks: chimeric antigen receptor (CAR) T cells engineered with an inducible cytokine to modulate the tumor stroma, Immunological Reviews, 257:83-90 (2014).

Tamada, K. et al., Redirecting Gene-Modified T Cells toward Various Cancer Types Using Tagged Antibodies, Clinical Cancer Research, 18(23):6436-6445 (2012).

\* cited by examiner

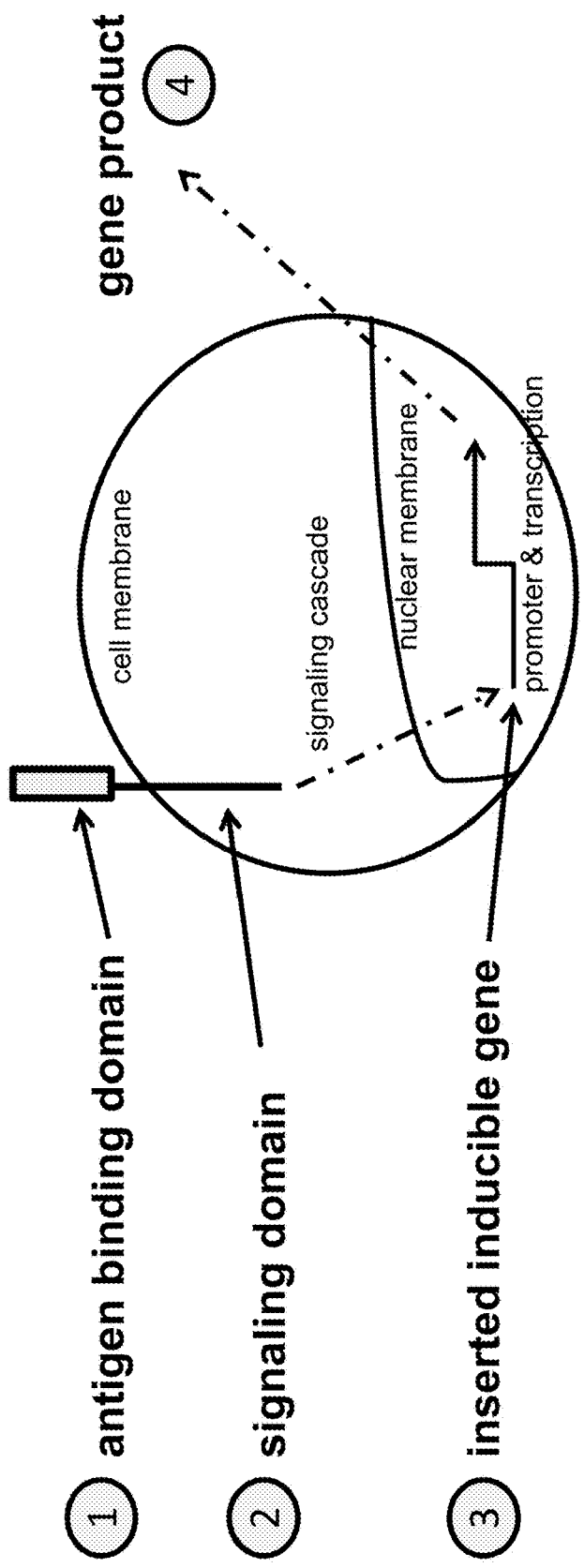
Figure 1: Novel Inducible Genes

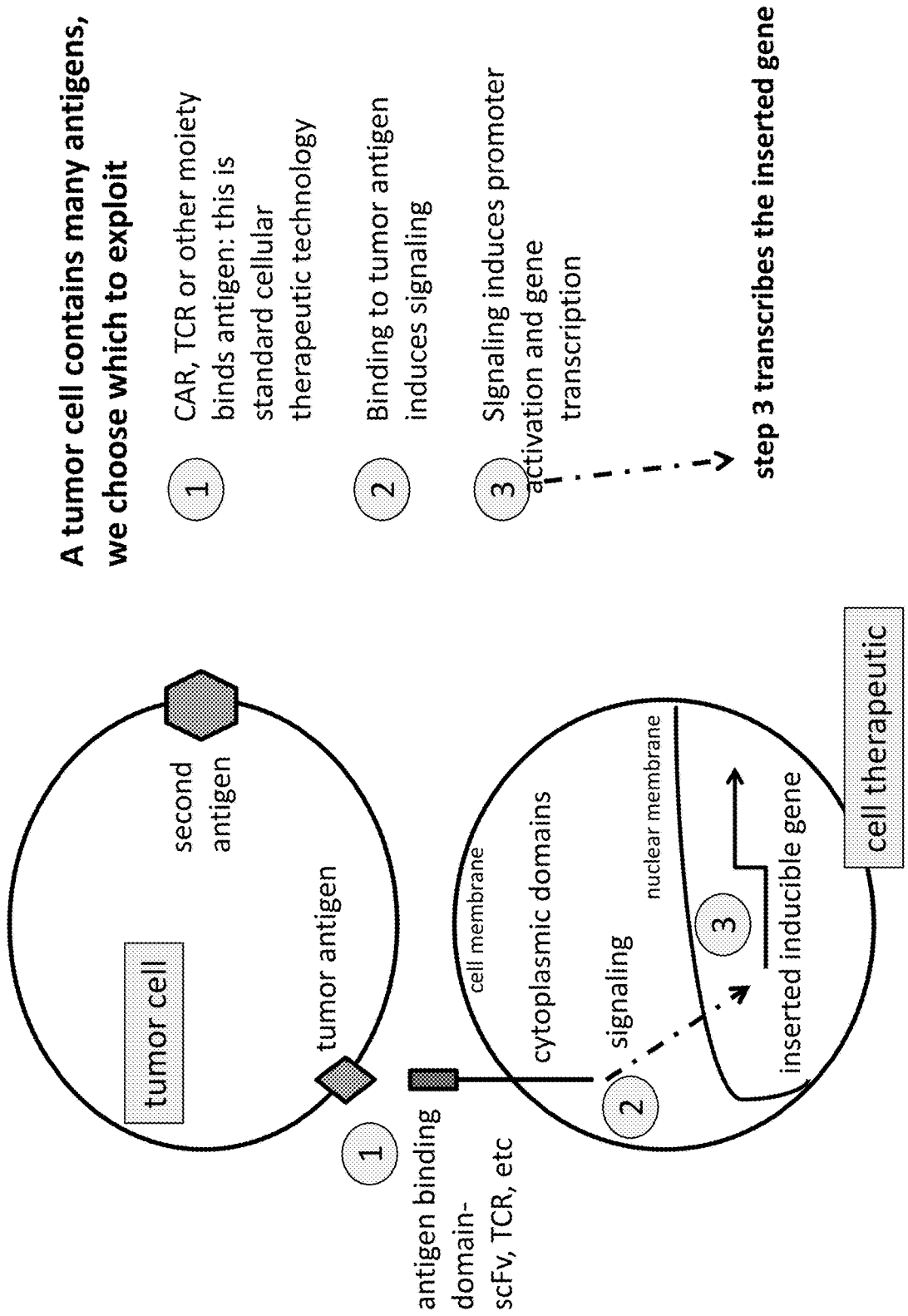
Figure 2: Basic example of expressed genes

Figure 8: Novel Inducible Genes – a cytokine example: IL15 for NK cell and effector T cell survival & expansion Figure 9: Novel Inducible Genes – an ADC example: ScFv-CD30 coats tumor cells with an ADC target

Figure 10: Inducible Genes – a toxin example: Diphtheria toxin is released locally and kills tumor cells

① antigen binding domain

② signaling domain

③ inserted inducible gene

Figure 11: Inducible genes and the local induction of other diverse factors

Figure 12A: CD19 as a scaffold, format A

Format 2A: CD19 as scaffold
A CD19 C2 domain is
mutagenized to bind a
target of interest directly;
A CAR19 T cell kills via CD19

Figure 12B: CD19 as a scaffold, format B

Format 2B: CD19 as scaffold
Both CD19 C2 domains are mutagenized to bind a target of interest directly; Analogous to VH/VL; this should be a more potent binder; a CAR19 T cell kills via CD19

Figure 12C: Mutagenesis of CD19 sequence

[Diagram: TARGET oval adjacent to ScFv composed of VH, VL, and CD19 C2 ovals]

Mutagenesis of loops in a CD19 C2 domain (or both), linked to an ScFv (or VHH or Fn-Type-III Domain, etc), provides further affinity and specificity to binding The CAR19 T cell kills via CD19

Constructs co-expressed, by lane, and the expected molecular weights:

1) # 1 + 4:   48.7kD, 23.3kD
2) # 32 + 1:  52.7kD, 48.7kD
3) # 33 + 4:  78.1kD, 23.3kD
4) # 34 + 1:  53.6kD, 48.7kD
5) # 35 + 4:  78.1kD, 23.3kD
6) # 36 + 7:  52.6kD, 48.6kD

Constructs co-expressed, by lane, and the expected molecular weights:

7) # 37 + 10:  77.9kD, 23kD
8) # 38 + 7:   53.5kD, 48.6kD
9) # 39 + 10:  78kD, 23kD
10) # 7 + 10:  48.6kD, 23kD

Figure 15
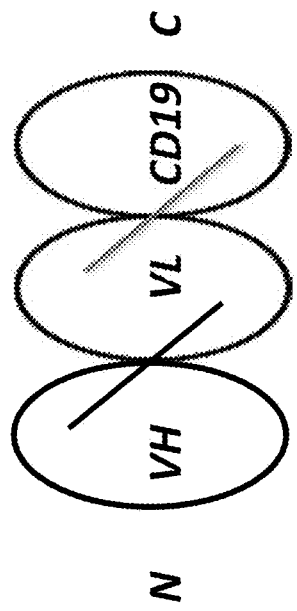
scFv-CD19 fusion: C terminus
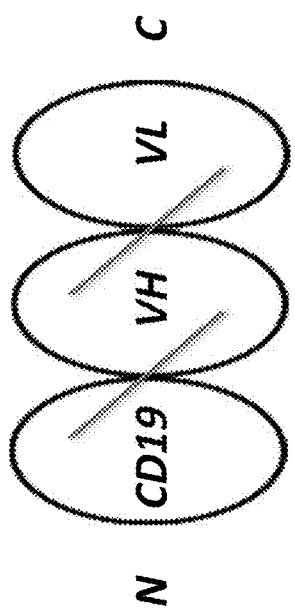
scFv-CD19 fusion: N terminus Constructs expressed, by lane, and the expected molecular weights. The detection method (via His-tag or human IgGFc domain) is indicated

HIS tagged

8) #40:   57.6kD
9) #42:   57kD

Fc fusions

11) #41:   82kD
12) #43:   81.4kD

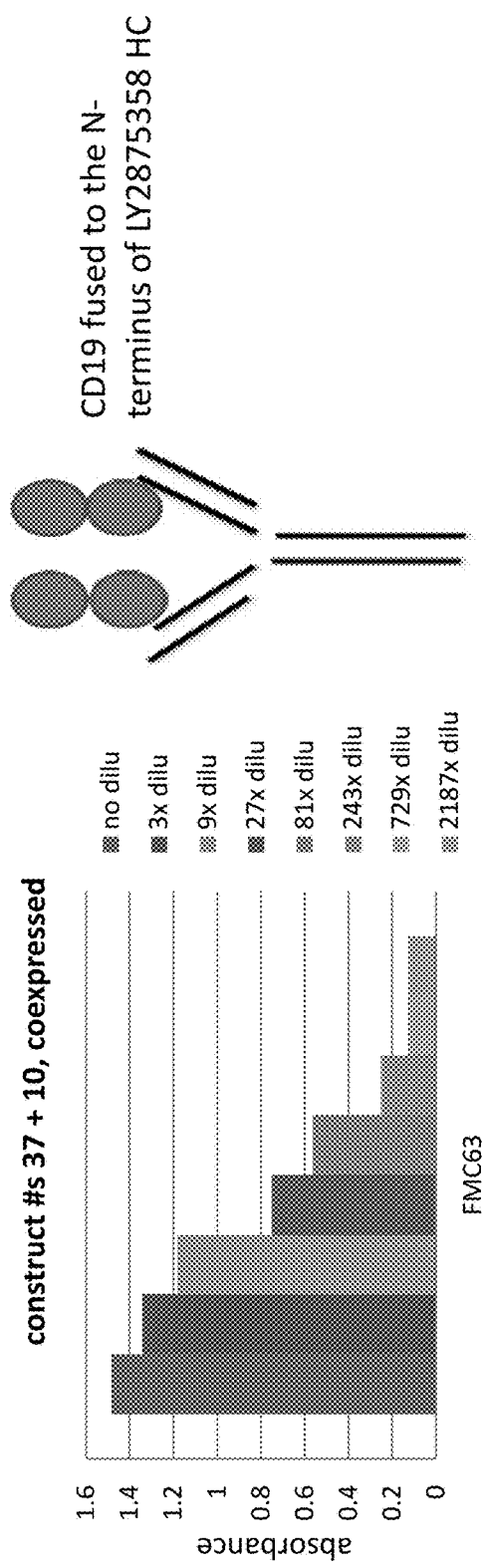
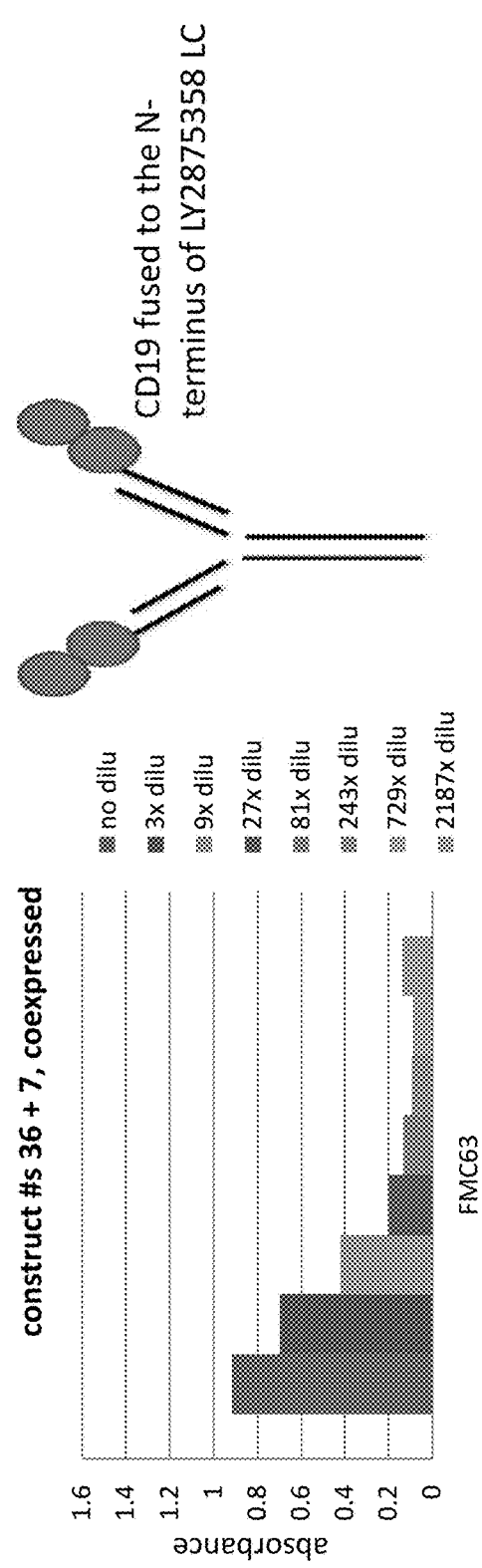

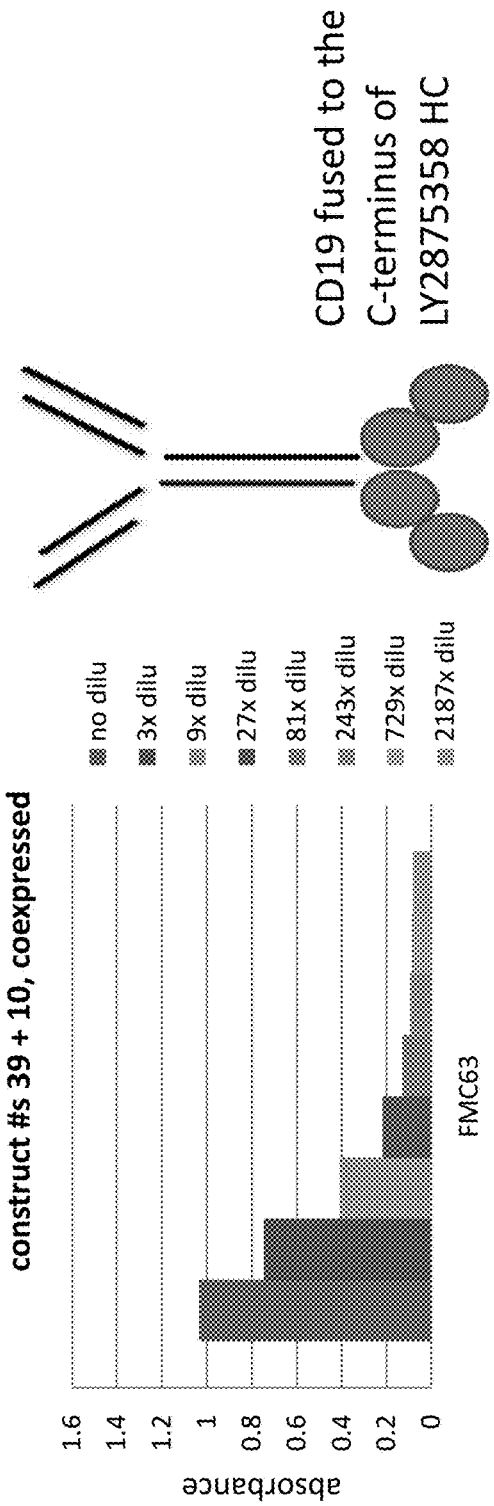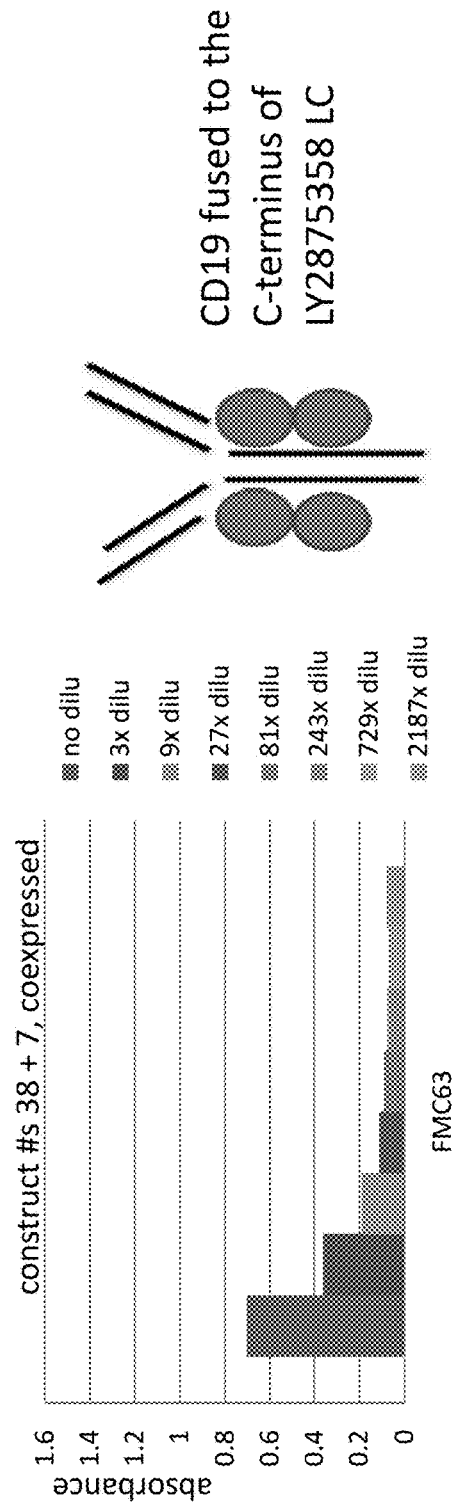

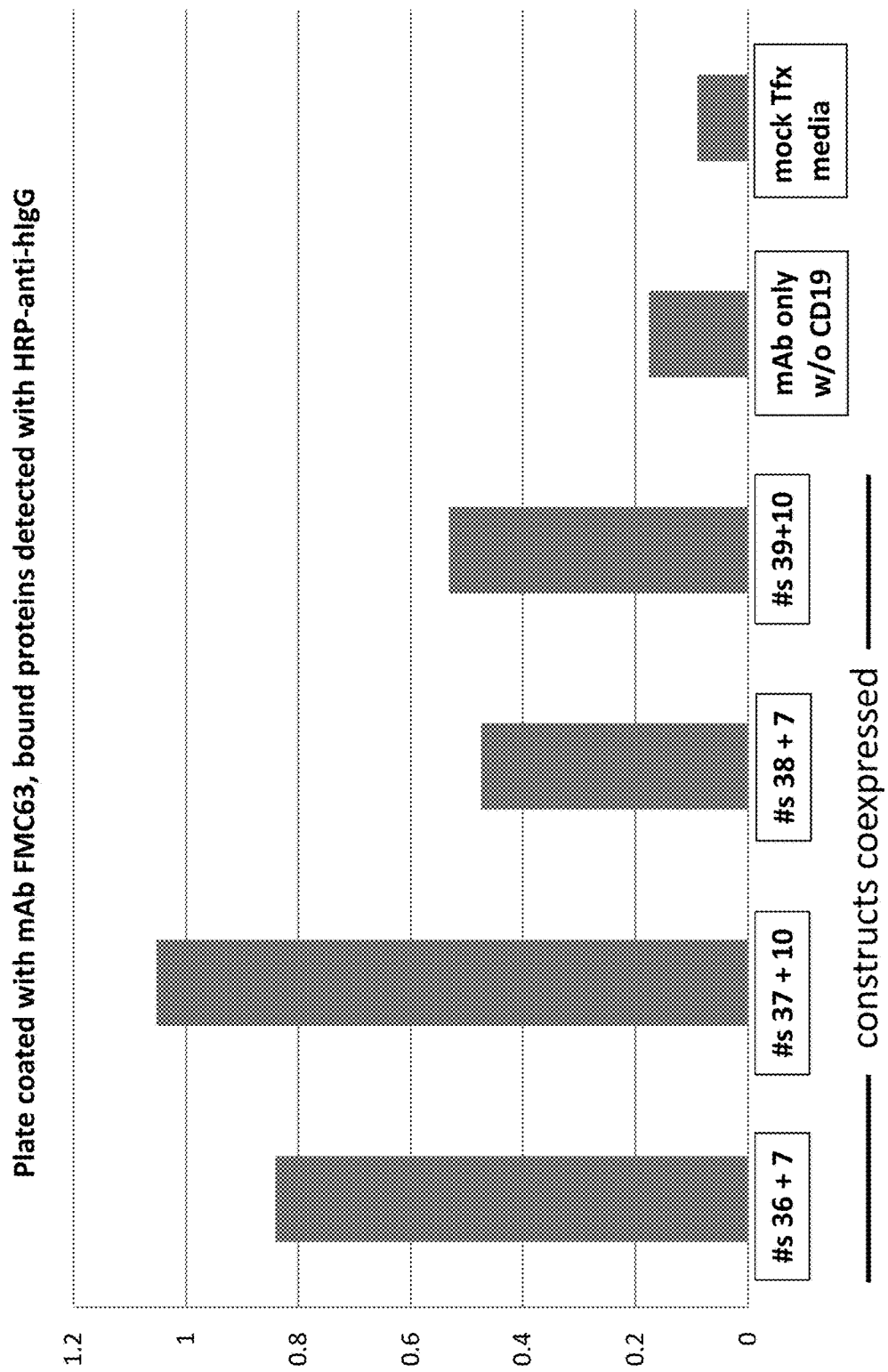

Figure 21 mAb-CD19 fusions: FMC63 binding and expression levels

| | N-term LC | C-term LC | N-term HC | C-term HC |
|---|---|---|---|---|
| panitumumab | + | +/- | ++ | +/- |
| expression | low | low | high | low |
| LY2875358 | + | + | ++ | + |
| expression | low | ? | medium | medium |

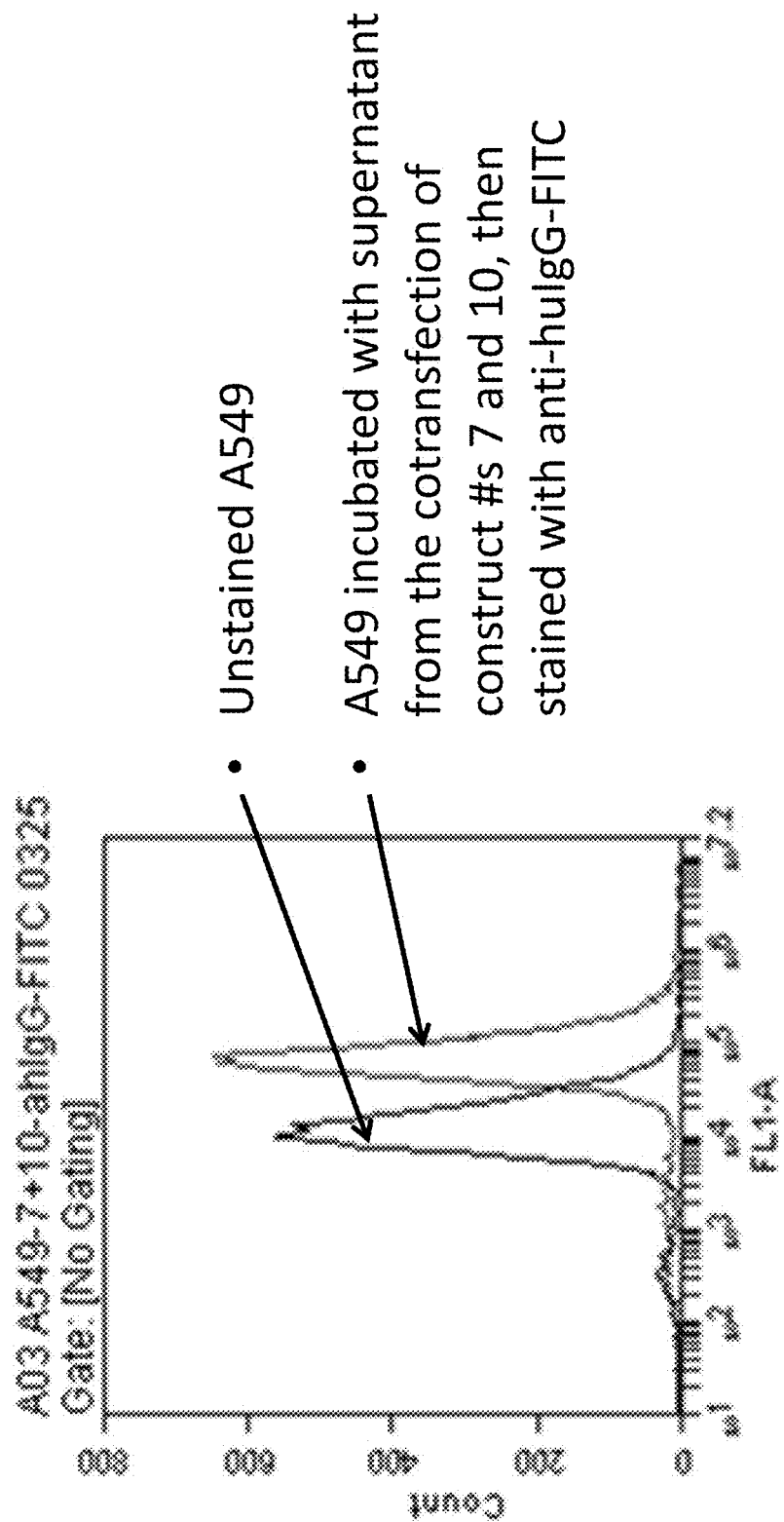

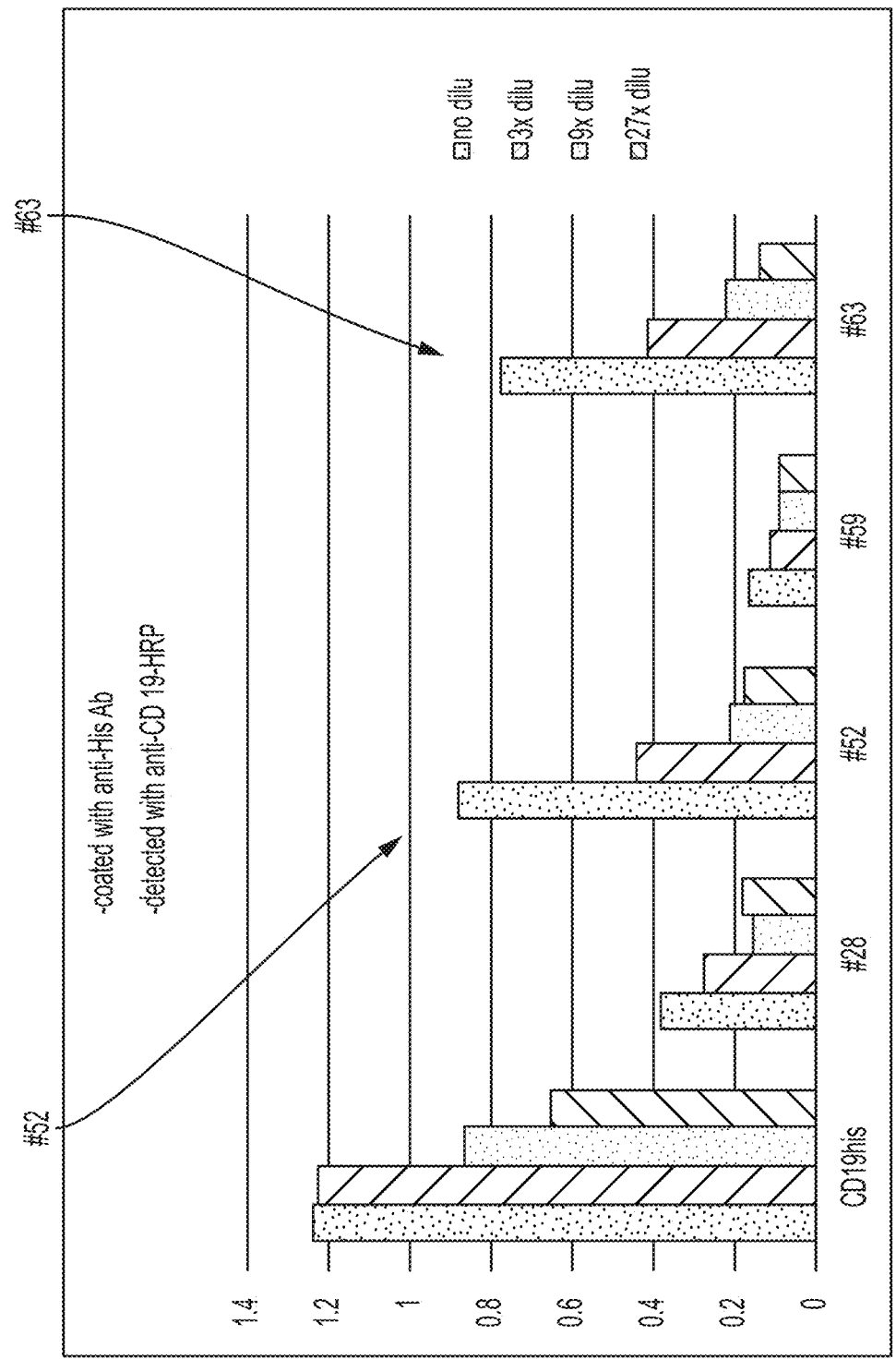

Construct #s used for the transfections are indicated

42

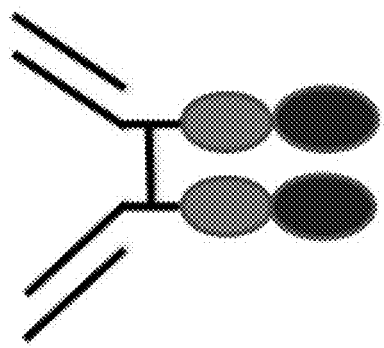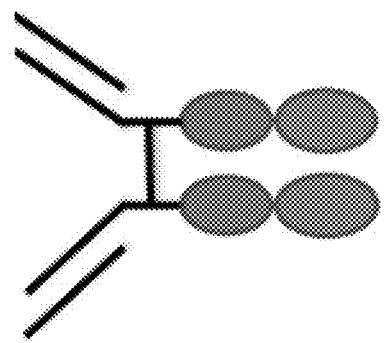

1, 2 or 3 CD19 loops grafted onto
Vh, Fn3 or scFv

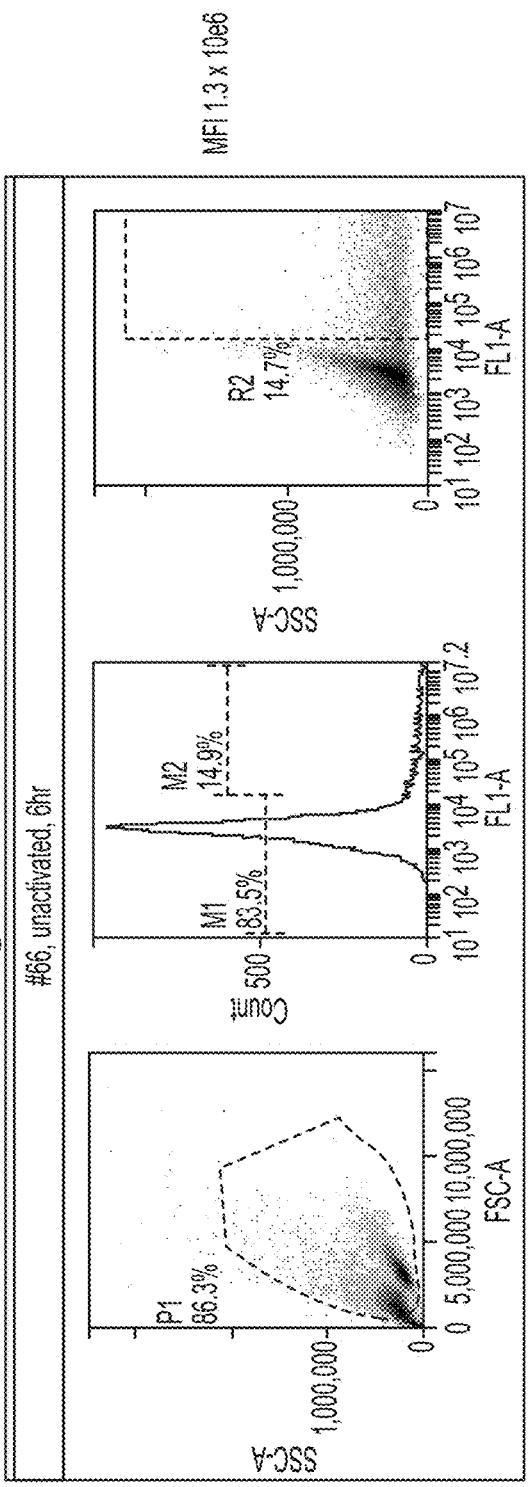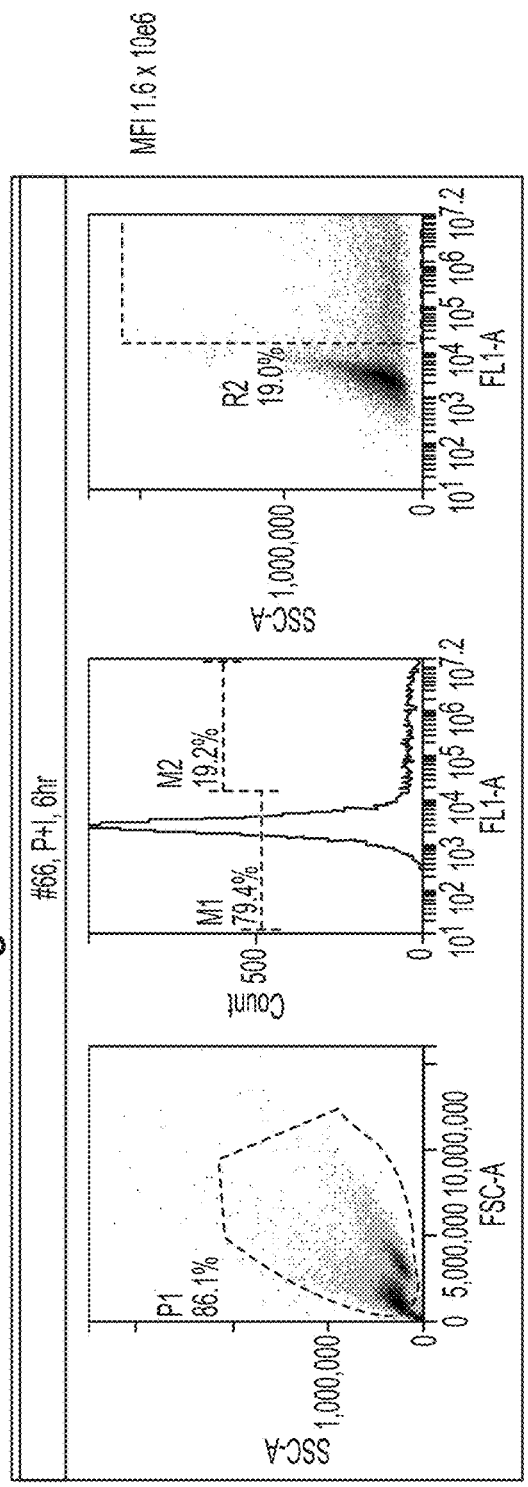

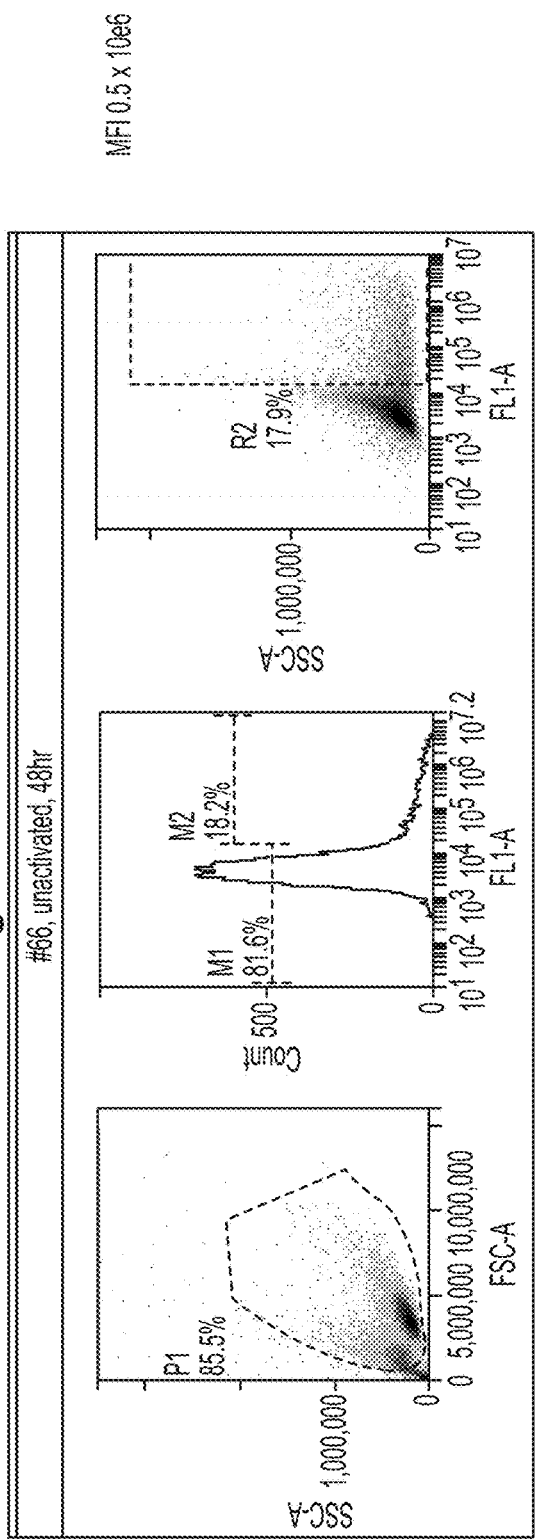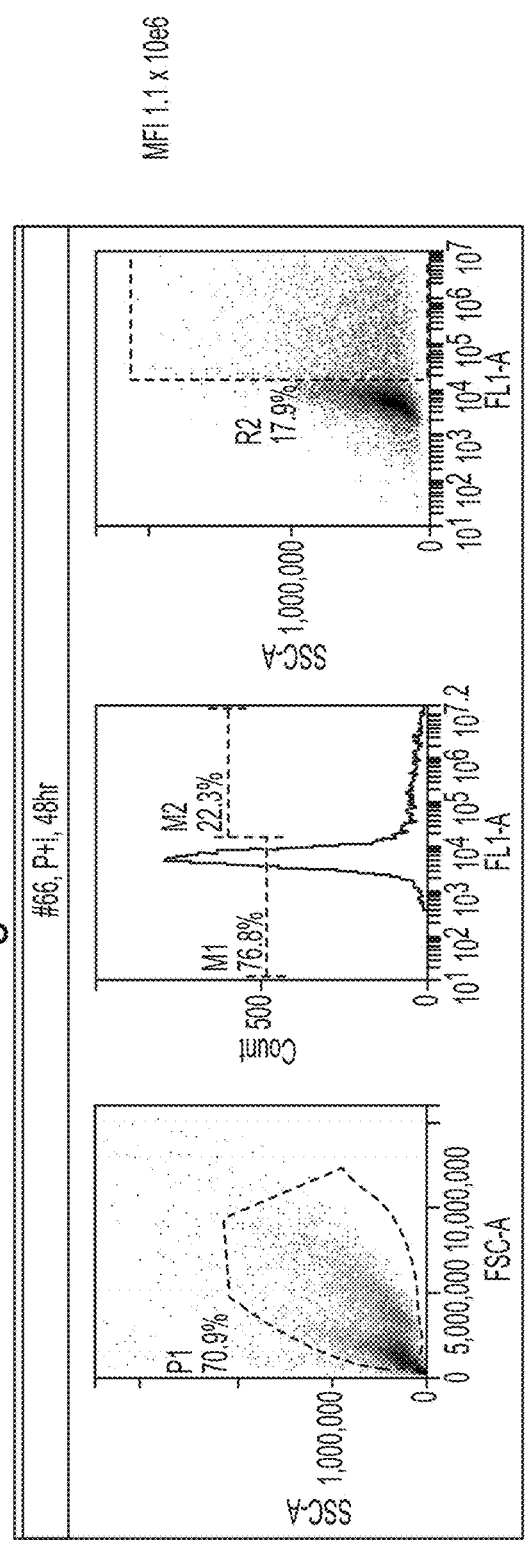

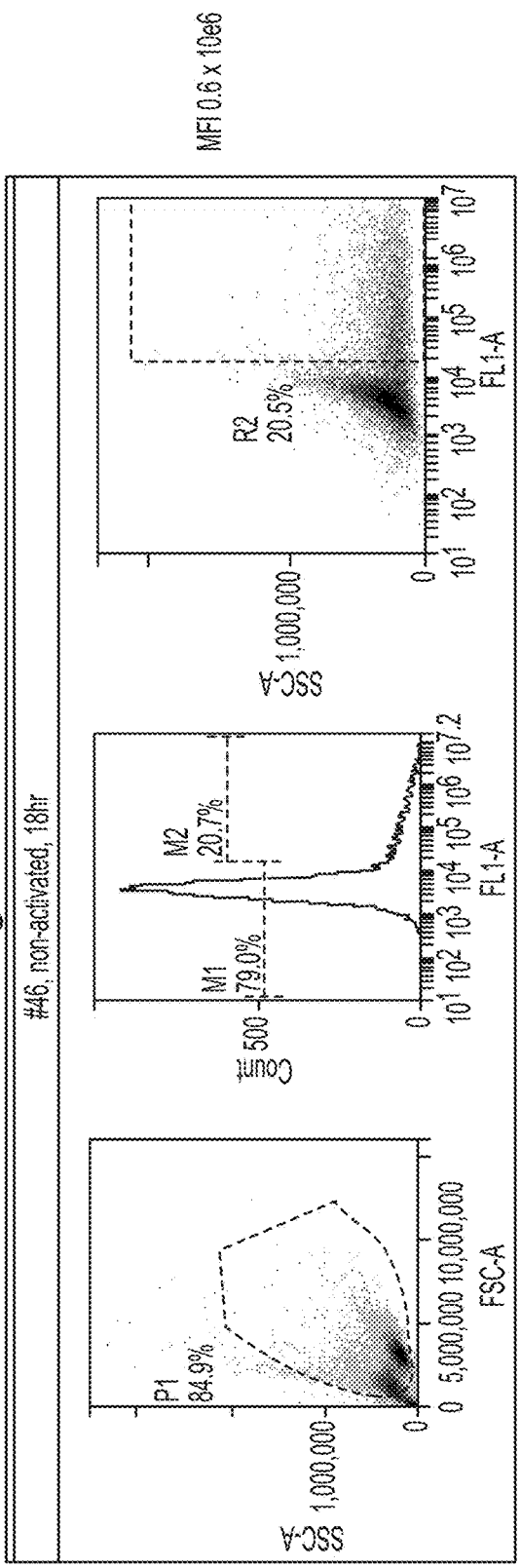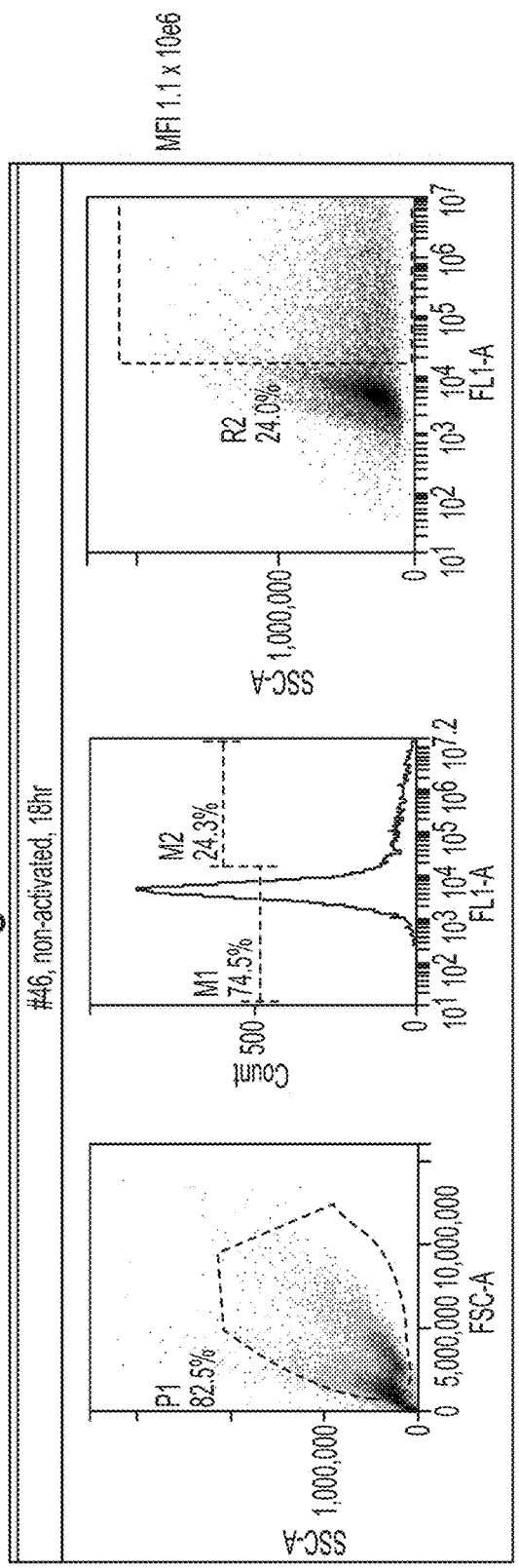

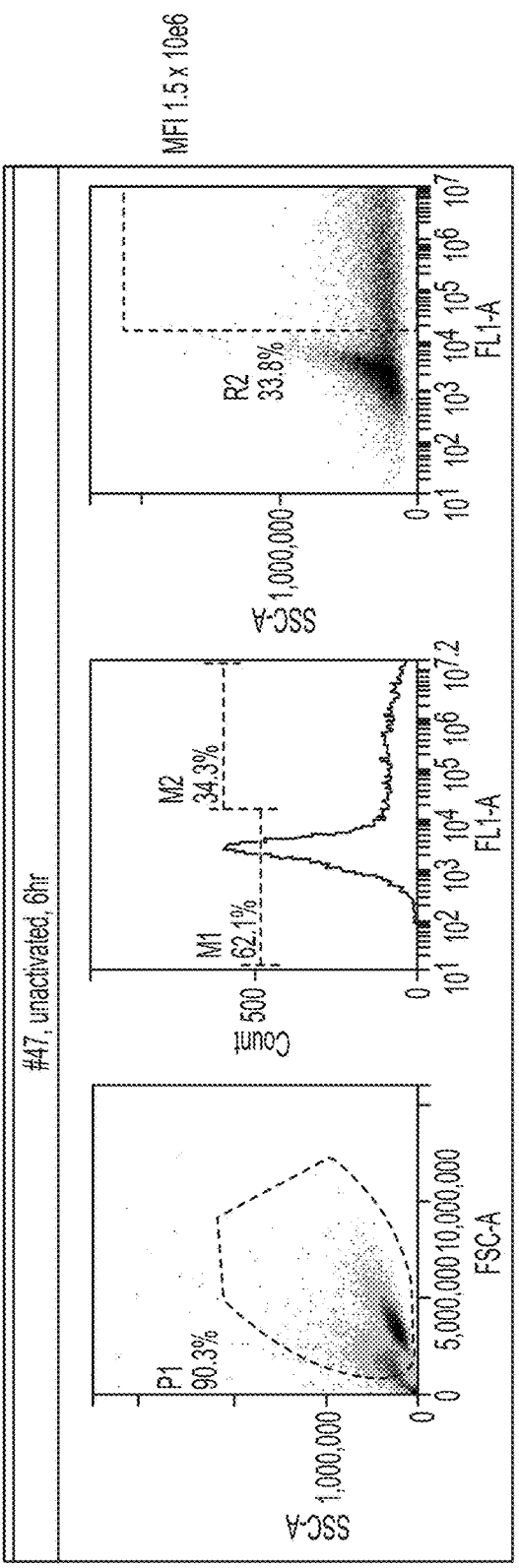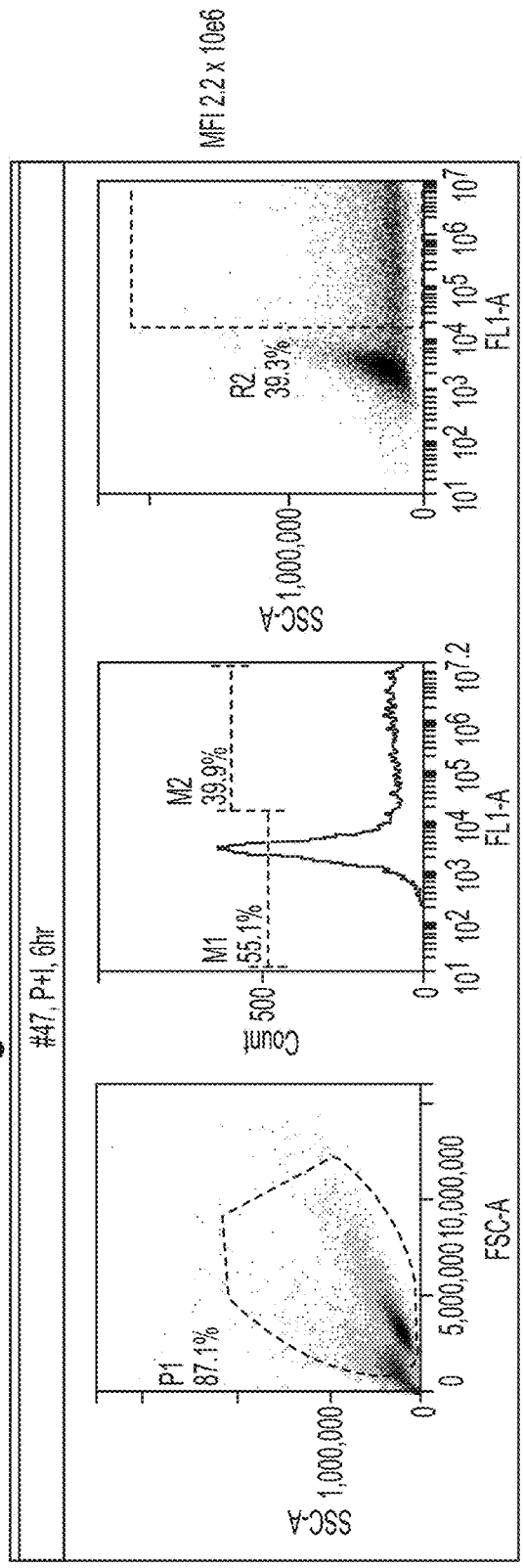

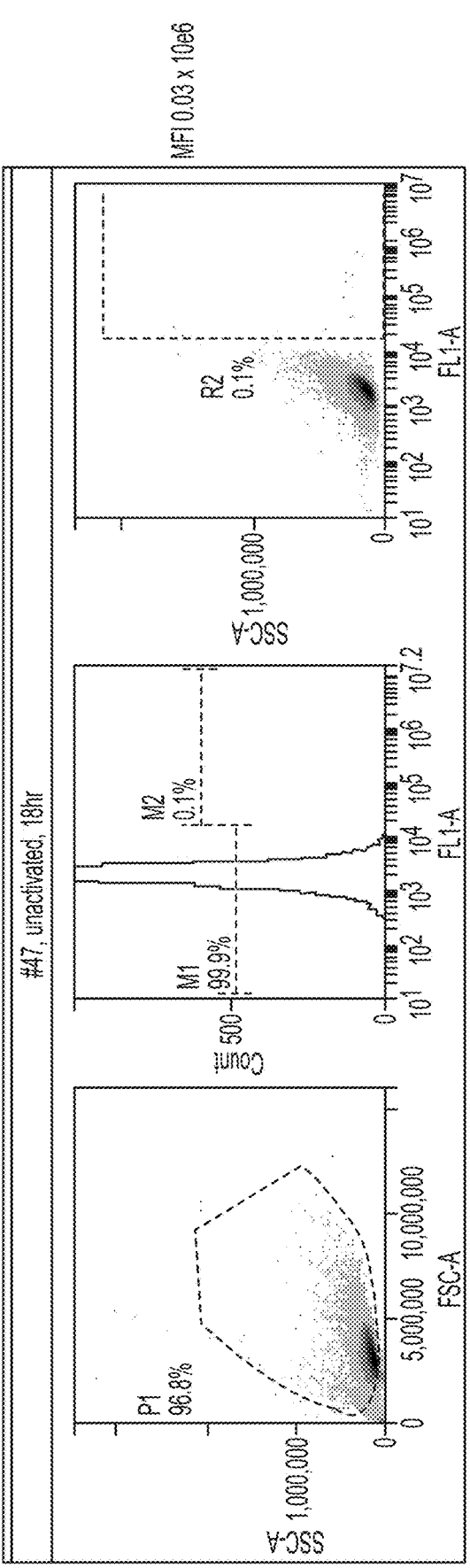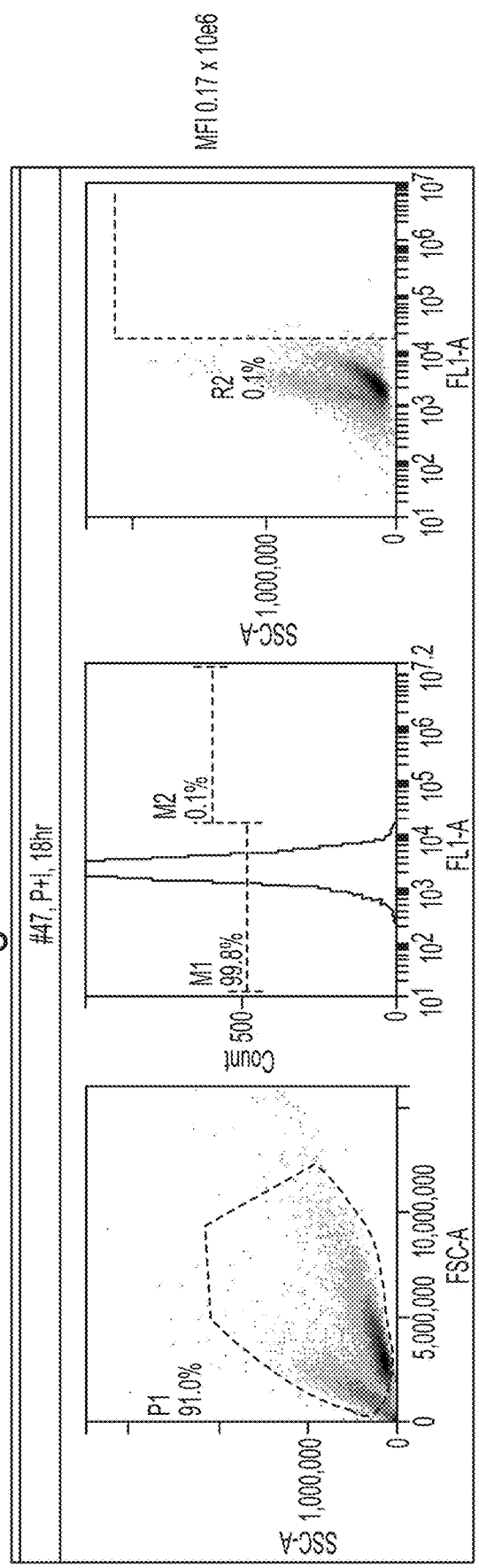
Figure 62C
Figure 62D

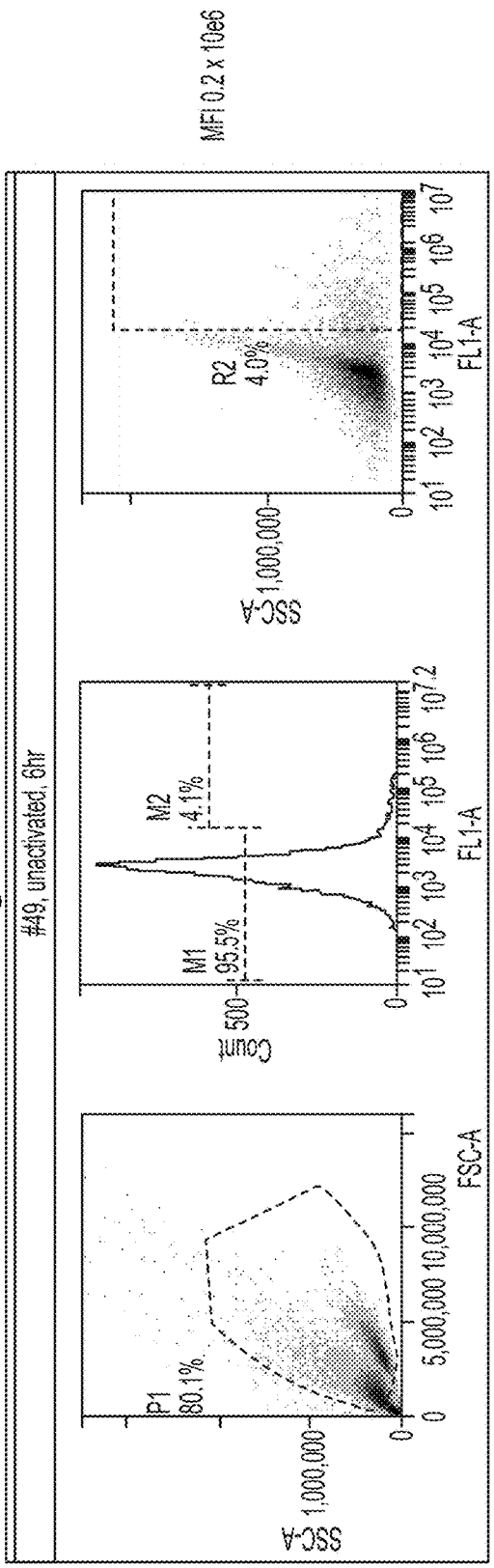
Figure 63A
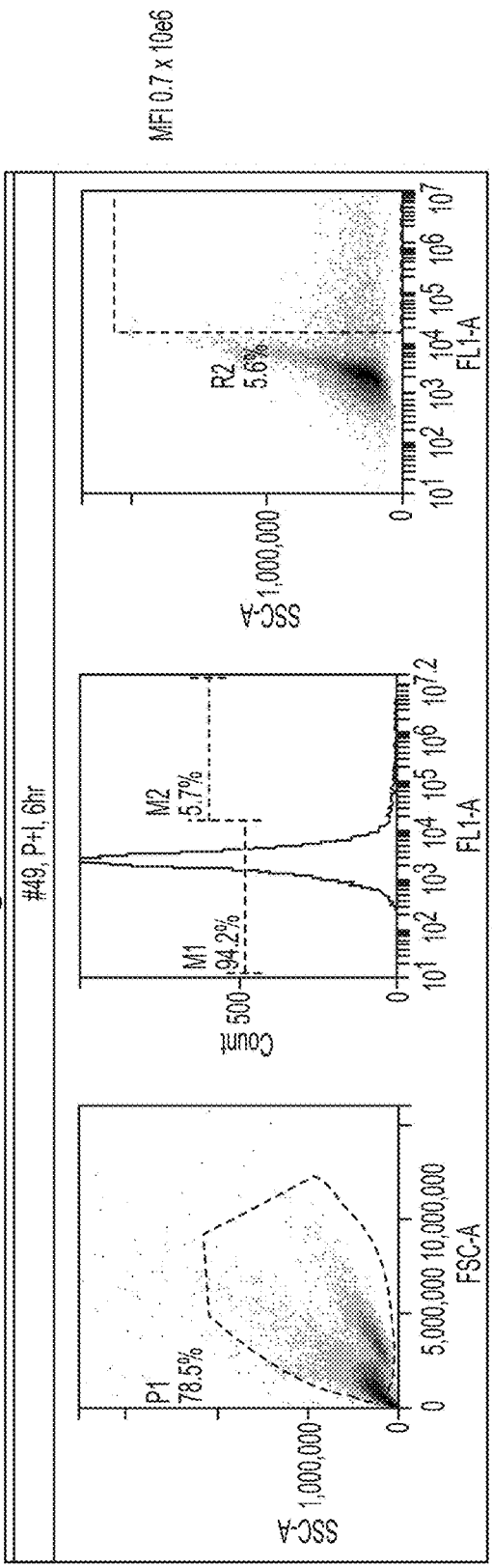
Figure 63B
FIG. 26

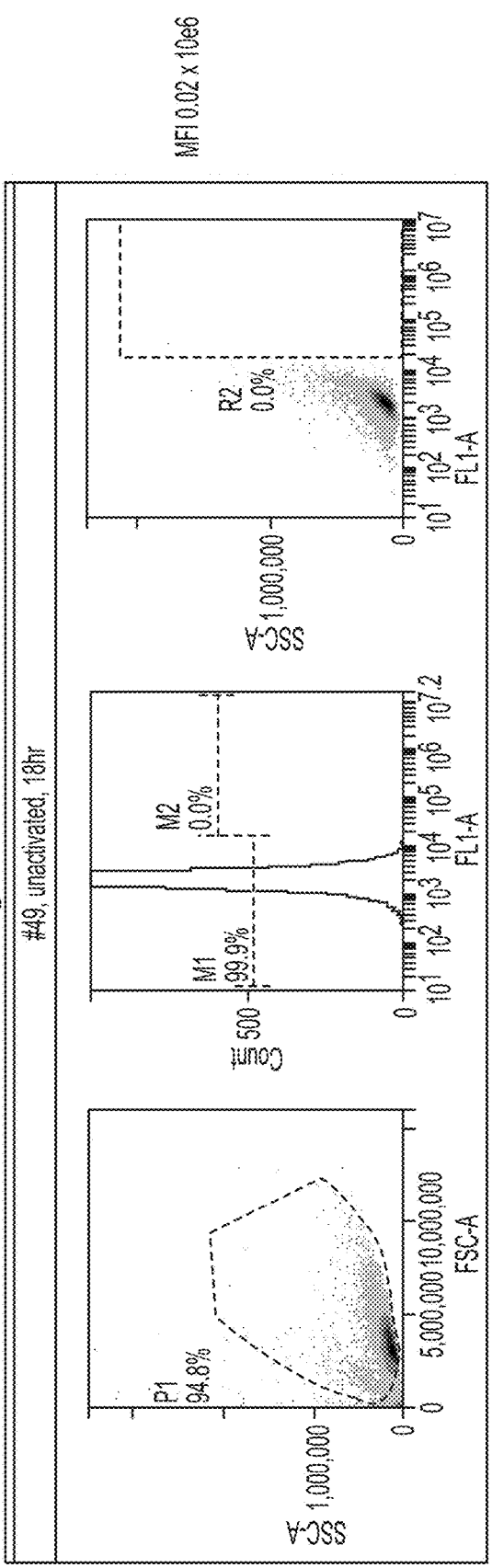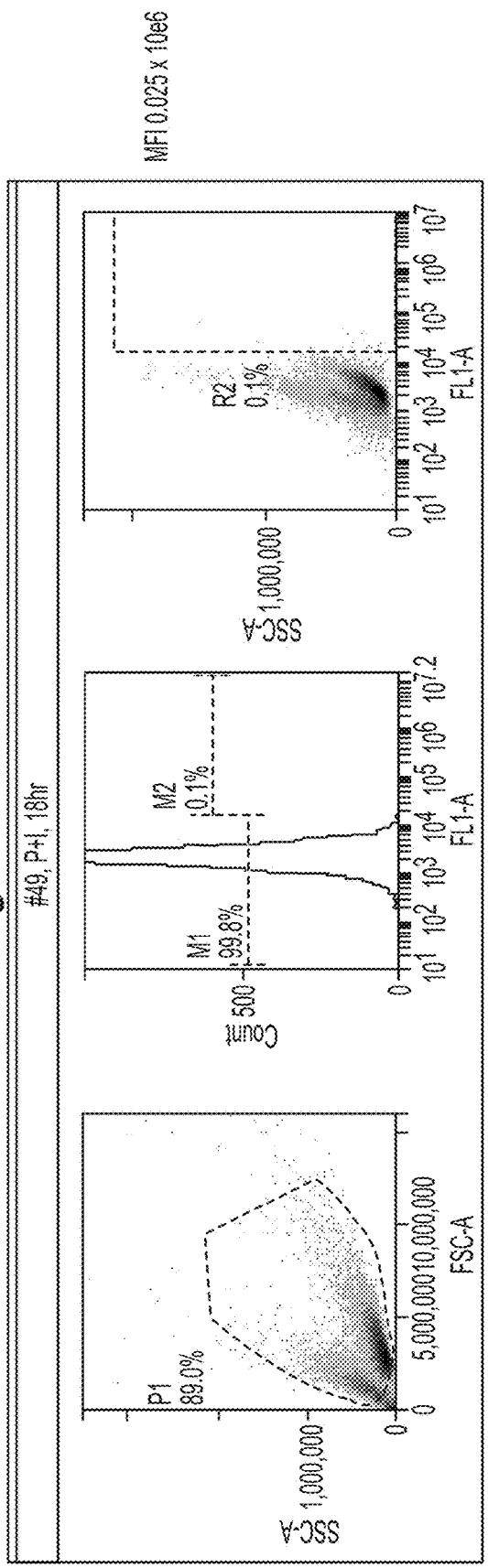

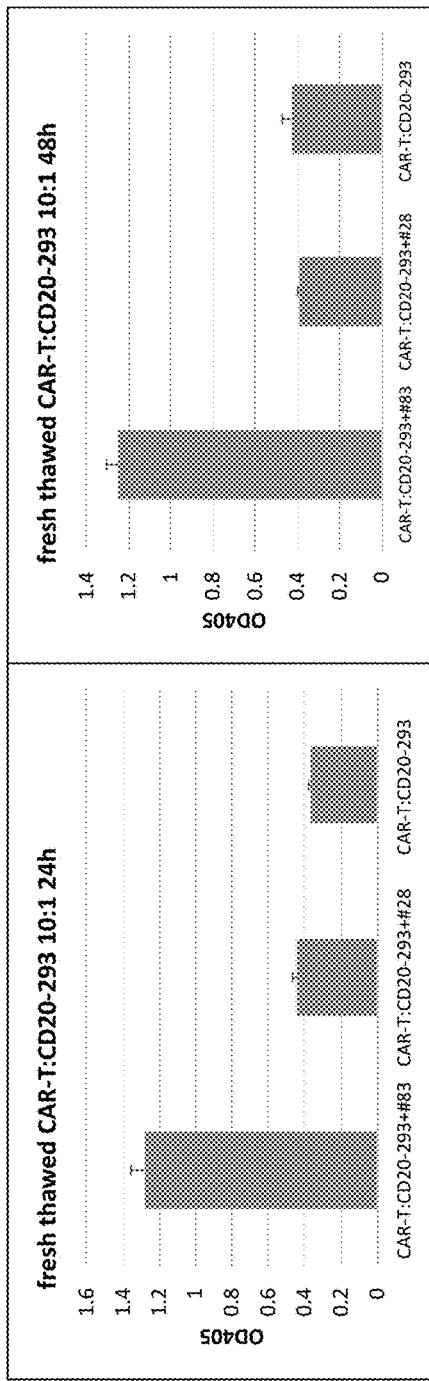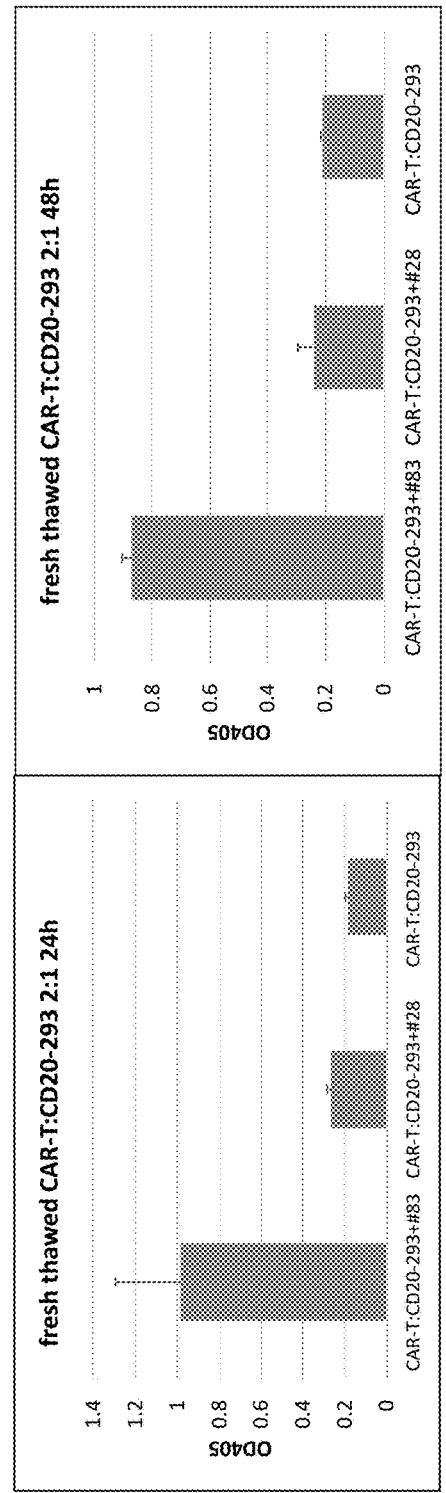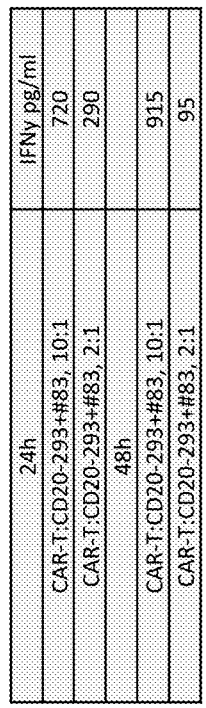

Fig. 81

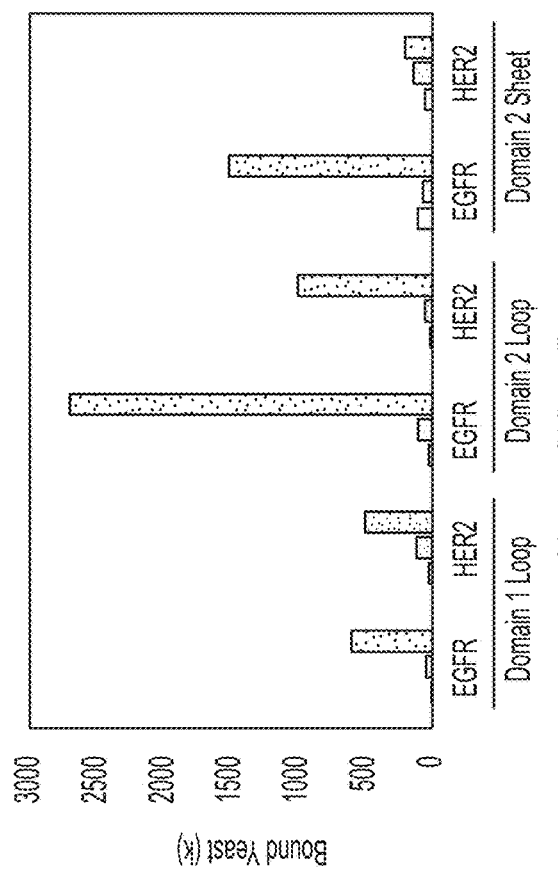
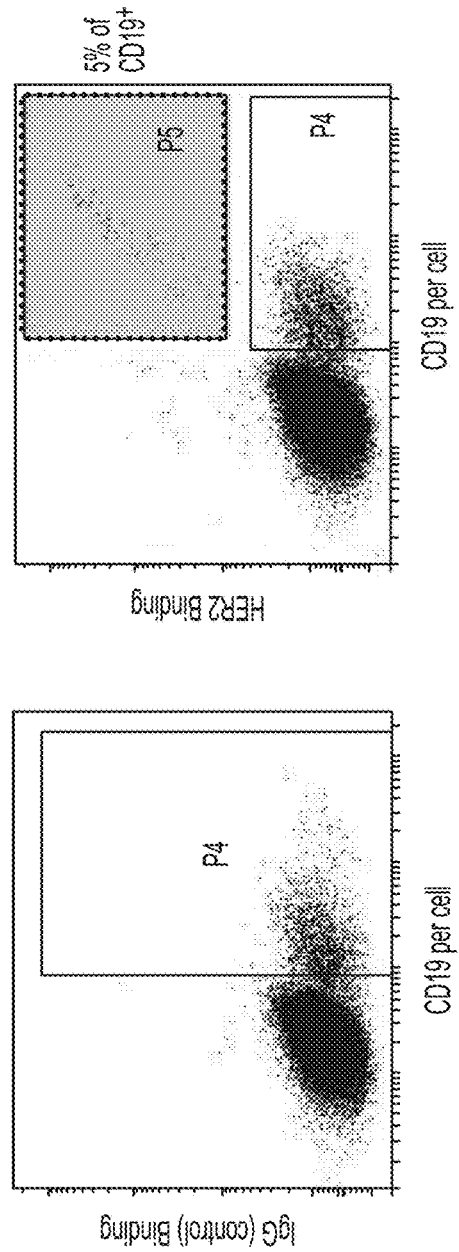
Figure 83A
Figure 83B

US 10,508,143 B1

COMPOSITIONS AND METHODS FOR TREATMENT OF CANCER

CROSS REFERENCE TO RELATED APPLICATIONS

This application is the National Stage of International Application No. PCT/US2016/059582, filed Oct. 28, 2016, which claims priority to each of U.S. Provisional Patent Application Nos. 62/249,144 filed Oct. 30, 2015; 62/331,010 filed May 3, 2016; and 62/396,783 filed Sep. 19, 2016, the entire contents of each of which are hereby incorporated by reference.

SEQUENCE LISTING

In accordance with 37 CFR 1.52(e)(5), the present specification makes reference to a Sequence Listing submitted electronically in the form of a text file (entitled "2012106-0009_SL.txt," created on Nov. 28, 2016, 713,739 bytes in size), the entire contents of which are incorporated herein by reference in their entirety.

BACKGROUND

Adoptive cell therapy (ACT) is a treatment method in which cells are removed from a donor, cultured and/or manipulated in vitro, and then administered to a patient for the treatment of a disease. A variety of cell types have been used in ACT in an attempt to treat several classes of disorders. For the treatment of cancer, ACT generally involves the transfer of lymphocytes, such as chimeric antigen receptor (CAR) T cells. Use of such CAR T cells involves identifying an antigen on a tumor cell to which a CAR T cell can bind, but tumor heterogeneity can make antigen identification challenging. Accordingly, there remains a need for improved methods for treating cancer using adoptive cell therapy.

SUMMARY

The present invention provides methods and compositions useful for treatment of cancer and/or for initiating or modulating immune responses. In some embodiments, the present invention provides cellular therapeutics (e.g., immune cells) comprising a constitutive expression construct, which comprises a promoter operably linked to a gene of interest. In some embodiments, the present invention provides cellular therapeutics (e.g., immune cells) comprising (i) an antigen binding receptor, wherein the antigen binding receptor comprises an antigen-binding domain, a transmembrane domain, and a cytosolic signaling domain, and (ii) an inducible expression construct, which comprises a promoter operably linked to a gene of interest. Among other things, the present invention encompasses the recognition that a combination of a cellular therapeutic described herein and one or more additional therapies (e.g., one or more additional cellular therapeutics (e.g., CAR-T cell, CAR-NK cell, TCR-T cell, TIL cell, allogenic NK cell, and autologous NK cell), antibody-drug conjugate, an antibody, and/or a polypeptide described herein), can lead to improved induction of beneficial immune responses, for example a cellular response (e.g., T-cell activation).

In some embodiments, the present disclosure provides methods of treating a subject having a tumor, comprising administering to the subject a cellular therapeutic described herein and/or a protein therapeutic described herein. In some embodiments, methods further comprise administration of one or more additional therapies (e.g., a second cellular therapeutic (e.g., CAR-T cell, CAR-NK cell, TCR-T cell, TIL cell, allogenic NK cell, and autologous NK cell), an antibody-drug conjugate, an antibody, and/or a polypeptide described herein).

Other features, objects, and advantages of the present invention are apparent in the detailed description that follows. It should be understood, however, that the detailed description, while indicating embodiments of the present invention, is given by way of illustration only, not limitation. Various changes and modifications within the scope of the invention will become apparent to those skilled in the art from the detailed description.

BRIEF DESCRIPTION OF THE DRAWINGS

The figures of the drawing are for illustration purposes only, not for limitation.

FIG. 1 is a schematic depicting an exemplary cellular therapeutic.

FIG. 15 is a schematic depicting exemplary antibody fusion proteins in which a polypeptide antigen is fused in various orientations to an scFv.

FIGS. 19A, 19B, 19C, and 19D show binding of LY2875358-CD19 fusion proteins to an anti-CD19 antibody (FMC63).

FIG. 20 shows binding of LY2875358-CD19 fusion proteins to an anti-CD19 antibody (FMC63) relative to negative controls.

FIG. 21 shows a summary of expression of, and FMC63 binding to, various antibody-CD19 fusion proteins.

FIGS. 23A, 23B, and 23C show binding of LY2875358-CD19 fusion proteins to c-Met expressing cells and to an anti-CD19 antibody (FMC63).

FIG. 26 shows binding of CD19-scFv fusion proteins captured on anti-His antibody-coated ELISA plates.

FIGS. 54A and 54B show exemplary Fc-based constructs that include an Fc Ig "swap".

FIGS. 60A-60D show analysis of GFP expression from the CMV promoter-tGFP construct (#66) under resting or activated conditions.

FIGS. 61A-61D show analysis of GFP expression from the human CD69 promoter-tGFP (#46) under resting or activated conditions.

FIGS. 62A-62D show analysis of GFP expression from the human TNFalpha promoter-tGFP (#47) under resting or activated conditions.

FIGS. 63A-63D show analysis of GFP expression from the human NFAT element×6 promoter-tGFP (#49) under resting or activated conditions.

FIGS. 69A-69D show results of IFNγ ELISA for construct #83 fusion protein.

FIG. 69A: 24 hrs, 10:1 effector:target ratio; FIG. 69B: 24 hrs, 2:1 effector:target ratio; FIG. 69C: 48 hrs, 10:1 effector:target ratio; FIG. 69D: 48 hrs, 2:1 effector:target ratio.

FIG. 71A: 48 hrs, 10:1 effector:target ratio; FIG. 71B 48 hrs, 2:1 effector:target ratio.

FIG. 72A: 24 hrs, 10:1 effector:target ratio. FIG. 72B: 24 hrs, 2:1 effector:target ratio.

FIG. 81 shows diversified regions of the extracellular domain.

FIGS. 83A and 83B demonstrate combinatorial CD19 libraries can be enriched for binding ligands to EGFR and HER2.

DEFINITIONS

Figure 2:
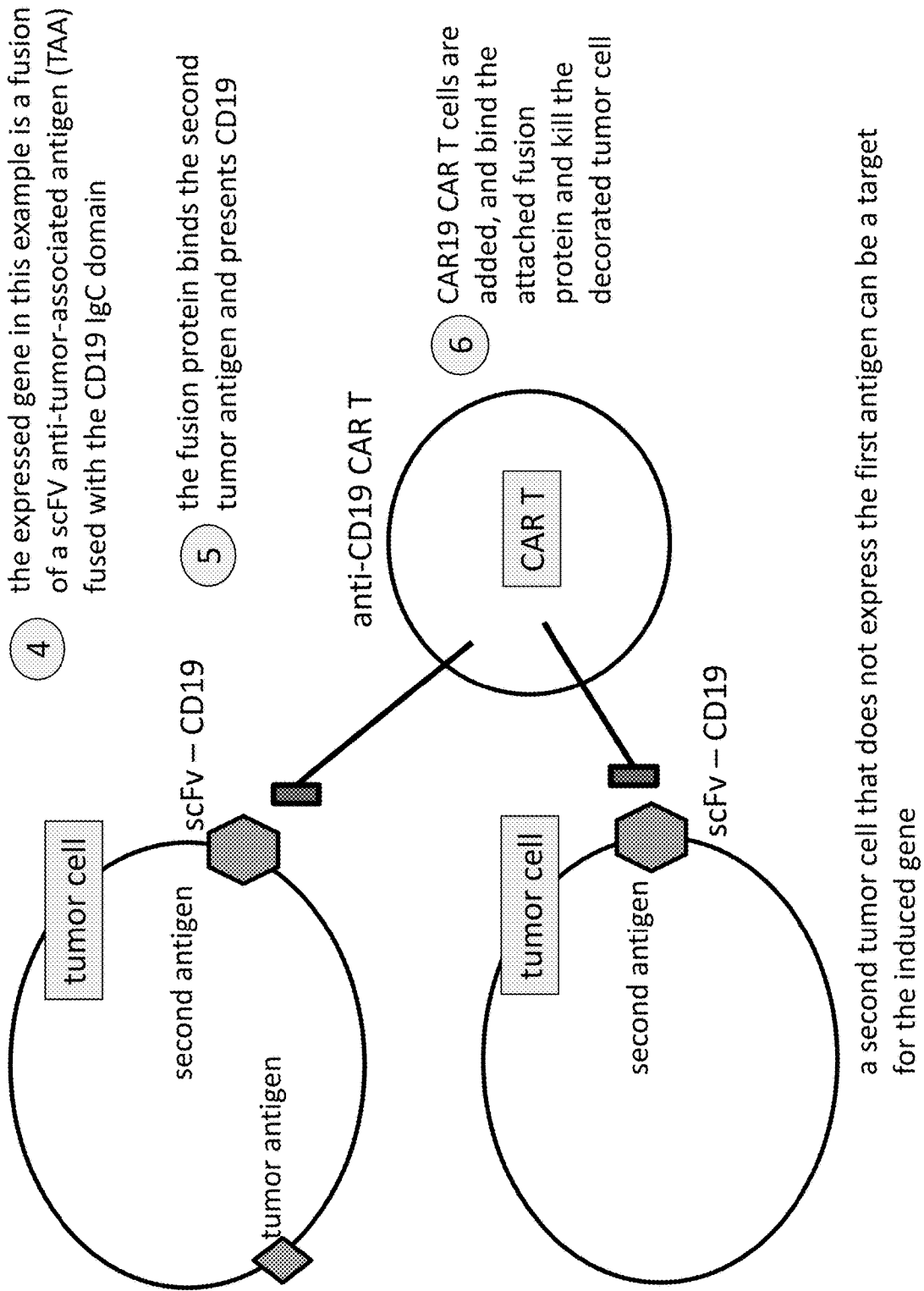
FIG. 2 is a schematic depicting an exemplary cellular therapeutic encoding an inducible scFv-CD19 fusion protein.

In order for the present invention to be more readily understood, certain terms are first defined below. Additional definitions for the following terms and other terms are set forth throughout the specification.

Administration: As used herein, the term "administration" refers to the administration of a composition to a subject or system. Administration to an animal subject (e.g., to a human) may be by any appropriate route. For example, in some embodiments, administration may be bronchial (including by bronchial instillation), buccal, enteral, interdermal, intra-arterial, intradermal, intragastric, intramedullary, intramuscular, intranasal, intraperitoneal, intrathecal, intravenous, intraventricular, within a specific organ (e.g., intrahepatic), mucosal, nasal, oral, rectal, subcutaneous, sublingual, topical, tracheal (including by intratracheal instillation), transdermal, vaginal and vitreal. In some embodiments, administration may be intratumoral or peritumoral. In some embodiments, administration may involve intermittent dosing. In some embodiments, administration may involve continuous dosing (e.g., perfusion) for at least a selected period of time.

Adoptive cell therapy: As used herein, "adoptive cell therapy" or "ACT" involves the transfer of immune cells with antitumour activity into cancer patients. In some embodiments, ACT is a treatment approach that involves the use of lymphocytes with antitumour activity, the in vitro expansion of these cells to large numbers and their infusion into a cancer-bearing host.

Agent: The term "agent" as used herein may refer to a compound or entity of any chemical class including, for example, polypeptides, nucleic acids, saccharides, lipids, small molecules, metals, or combinations thereof. As will be clear from context, in some embodiments, an agent can be or comprise a cell or organism, or a fraction, extract, or component thereof. In some embodiments, an agent is or comprises a natural product in that it is found in and/or is obtained from nature. In some embodiments, an agent is or comprises one or more entities that is man-made in that it is designed, engineered, and/or produced through action of the hand of man and/or is not found in nature. In some embodiments, an agent may be utilized in isolated or pure form; in some embodiments, an agent may be utilized in crude form. In some embodiments, potential agents are provided as collections or libraries, for example that may be screened to identify or characterize active agents within them. Some particular embodiments of agents that may be utilized in accordance with the present invention include small molecules, antibodies, antibody fragments, aptamers, nucleic acids (e.g., siRNAs, shRNAs, DNA/RNA hybrids, antisense oligonucleotides, ribozymes), peptides, peptide mimetics, etc. In some embodiments, an agent is or comprises a polymer. In some embodiments, an agent is not a polymer and/or is substantially free of any polymer. In some embodiments, an agent contains at least one polymeric moiety. In some embodiments, an agent lacks or is substantially free of any polymeric moiety.

Amelioration: As used herein, "amelioration" refers to prevention, reduction and/or palliation of a state, or improvement of the state of a subject. Amelioration includes, but does not require, complete recovery or complete prevention of a disease, disorder or condition.

Amino acid: As used herein, term "amino acid," in its broadest sense, refers to any compound and/or substance that can be incorporated into a polypeptide chain. In some embodiments, an amino acid has the general structure $H_2N\text{—}C(H)(R)\text{—}COOH$. In some embodiments, an amino acid is a naturally occurring amino acid. In some embodiments, an amino acid is a synthetic amino acid; in some embodiments, an amino acid is a d-amino acid; in some embodiments, an amino acid is an l-amino acid. "Standard amino acid" refers to any of the twenty standard l-amino acids commonly found in naturally occurring peptides. "Nonstandard amino acid" refers to any amino acid, other than the standard amino acids, regardless of whether it is prepared synthetically or obtained from a natural source. As used herein, "synthetic amino acid" encompasses chemically modified amino acids, including but not limited to salts, amino acid derivatives (such as amides), and/or substitutions. Amino acids, including carboxy- and/or amino-terminal amino acids in peptides, can be modified by methylation, amidation, acetylation, protecting groups, and/or substitution with other chemical groups that can change the peptide's circulating half-life without adversely affecting their activity. Amino acids may participate in a disulfide bond. Amino acids may comprise one or posttranslational modifications, such as association with one or more chemical entities (e.g., methyl groups, acetate groups, acetyl groups, phosphate groups, formyl moieties, isoprenoid groups, sulfate groups, polyethylene glycol moieties, lipid moieties, carbohydrate moieties, biotin moieties, etc.). The term "amino acid" is used interchangeably with "amino acid residue," and may refer to a free amino acid and/or to an amino acid residue of a peptide. It will be apparent from the context in which the term is used whether it refers to a free amino acid or a residue of a peptide.

Antibody: As used herein, the term "antibody" refers to a polypeptide that includes canonical immunoglobulin sequence elements sufficient to confer specific binding to a particular target antigen. As is known in the art, intact antibodies as produced in nature are approximately 150 kD tetrameric agents comprised of two identical heavy chain polypeptides (about 50 kD each) and two identical light chain polypeptides (about 25 kD each) that associate with each other into what is commonly referred to as a "Y-shaped" structure. Each heavy chain is comprised of at least four domains (each about 110 amino acids long)—an amino-terminal variable (VH) domain (located at the tips of the Y structure), followed by three constant domains: CH1, CH2, and the carboxy-terminal CH3 (located at the base of the Y's stem). A short region, known as the "switch", connects the heavy chain variable and constant regions. The "hinge" connects CH2 and CH3 domains to the rest of the antibody. Two disulfide bonds in this hinge region connect the two heavy chain polypeptides to one another in an intact antibody. Each light chain is comprised of two domains—an amino-terminal variable (VL) domain, followed by a carboxy-terminal constant (CL) domain, separated from one another by another "switch". Intact antibody tetramers are composed of two heavy chain-light chain dimers in which the heavy and light chains are linked to one another by a single disulfide bond; two other disulfide bonds connect the heavy chain hinge regions to one another, so that the dimers are connected to one another and the tetramer is formed. Naturally-produced antibodies are also glycosylated, typically on the CH2 domain. Each domain in a natural antibody has a structure characterized by an "immunoglobulin fold" formed from two beta sheets (e.g., 3-, 4-, or 5-stranded sheets) packed against each other in a compressed antiparallel beta barrel. Each variable domain contains three hypervariable loops known as "complement determining regions" (CDR1, CDR2, and CDR3) and four somewhat invariant "framework" regions (FR1, FR2, FR3, and FR4). When natural antibodies fold, the FR regions form the beta sheets that provide the structural framework for the domains, and the CDR loop regions from both the heavy and light chains are brought together in three-dimensional space so that they create a single hypervariable antigen binding site located at the tip of the Y structure. The Fc region of naturally-occurring antibodies binds to elements of the complement system, and also to receptors on effector cells, including for example effector cells that mediate cytotoxicity. As is known in the art, affinity and/or other binding attributes of Fc regions for Fc receptors can be modulated through glycosylation or other modification. In some embodiments, antibodies produced and/or utilized in accordance with the present disclosure include glycosylated Fc domains, including Fc domains with modified or engineered such glycosylation. For purposes of the present disclosure, in certain embodiments, any polypeptide or complex of polypeptides that includes sufficient immunoglobulin domain sequences as found in natural antibodies can be referred to and/or used as an "antibody", whether such polypeptide is naturally produced (e.g., generated by an organism reacting to an antigen), or produced by recombinant engineering, chemical synthesis, or other artificial system or methodology. In some embodiments, an antibody is polyclonal; in some embodiments, an antibody is monoclonal. In some embodiments, an antibody has constant region sequences that are characteristic of mouse, rabbit, primate, or human antibodies. In some embodiments, antibody sequence elements are fully human, or are humanized, primatized, chimeric, etc, as is known in the art. Moreover, the term "antibody" as used herein, can refer in appropriate embodiments (unless otherwise stated or clear from context) to any of the art-known or developed constructs or formats for utilizing antibody structural and functional features in alternative presentation. For example, in some embodiments, an antibody utilized in accordance with the present disclosure is in a format selected from, but not limited to, intact IgG, IgE and IgM, bi- or multi-specific antibodies (e.g., Zybodies®, etc), single chain Fvs, polypeptide-Fc fusions, Fabs, cameloid antibodies, masked antibodies (e.g., Probodies®), Small Modular ImmunoPharmaceuticals ("SMIPs™"), single chain or Tandem diabodies (TandAb®), Anticalins®, Nanobodies®, minibodies, BiTE®s, ankyrin repeat proteins or DARPINs®, Avimers®, a DART, a TCR-like antibody, Adnectins®, Affilins®, Trans-bodies®, Affibodies®, a TrimerX®, MicroProteins, Fynomers®, Centyrins®, and a KALBITOR®. In some embodiments, an antibody may lack a covalent modification (e.g., attachment of a glycan) that it would have if produced naturally. In some embodiments, an antibody may contain a covalent modification (e.g., attachment of a glycan, a payload (e.g., a detectable moiety, a therapeutic moiety, a catalytic moiety, etc.), or other pendant group (e.g., poly-ethylene glycol, etc.)).

Antibody Dependent Cellular Cytotoxicity: As used herein, the term "antibody-dependent cellular cytotoxicity" or "ADCC" refers to a phenomenon in which target cells bound by antibody are killed by immune effector cells. Without wishing to be bound by any particular theory, ADCC is typically understood to involve Fc receptor (FcR)-bearing effector cells can recognizing and subsequently killing antibody-coated target cells (e.g., cells that express on their surface specific antigens to which an antibody is bound). Effector cells that mediate ADCC can include immune cells, including but not limited to one or more of natural killer (NK) cells, macrophage, neutrophils, eosinophils.

Antibody Fragment: As used herein, an "antibody fragment" includes a portion of an intact antibody, such as, for example, the antigen-binding or variable region of an antibody. Examples of antibody fragments include Fab, Fab', F(ab')$_2$, and Fv fragments; triabodies; tetrabodies; linear antibodies; single-chain antibody molecules; and multi-specific antibodies formed from antibody fragments. For example, antibody fragments include isolated fragments, "Fv" fragments (consisting of the variable regions of the heavy and light chains), recombinant single chain polypeptide molecules in which heavy and light chain variable regions are connected by a peptide linker ("scFv proteins"), recombinant single domain antibodies consisting of a variable region of an antibody heavy chain (e.g., VHH), and minimal recognition units consisting of the amino acid residues that mimic a hypervariable region (e.g., a hypervariable region of a heavy chain variable region (VH), a hypervariable region of a light chain variable region (VL), one or more CDR domains within the VH, and/or one or more CDR domains within the VL). In many embodiments, an antibody fragment contains sufficient sequence of the parent antibody of which it is a fragment that it binds to the same antigen as does the parent antibody; in some embodiments, a fragment binds to the antigen with a comparable affinity to that of the parent antibody and/or competes with the parent antibody for binding to the antigen. Examples of antigen binding fragments of an antibody include, but are not limited to, Fab fragment, Fab' fragment, F(ab')$_2$ fragment, scFv fragment, Fv fragment, dsFv diabody, dAb fragment, Fd' fragment, Fd fragment, heavy chain variable region, and an isolated complementarity determining region (CDR) region. An antigen binding fragment of an antibody may be produced by any means. For example, an antigen binding fragment of an antibody may be enzymatically or chemically produced by fragmentation of an intact antibody and/or it may be recombinantly produced from a gene encoding the partial antibody sequence. Alternatively or additionally, antigen binding fragment of an antibody may be wholly or partially synthetically produced. An antigen binding fragment of an antibody may optionally comprise a single chain antibody fragment. Alternatively or additionally, an antigen binding fragment of an antibody may comprise multiple chains which are linked together, for example, by disulfide linkages. An antigen binding fragment of an antibody may optionally comprise a multimolecular complex. A functional antibody fragment typically comprises at least about 50 amino acids and more typically comprises at least about 200 amino acids.

Antigen: The term "antigen", as used herein, refers to an agent that elicits an immune response; and/or an agent that binds to a T cell receptor (e.g., when presented by an WIC molecule) or to an antibody or antibody fragment. In some embodiments, an antigen elicits a humoral response (e.g., including production of antigen-specific antibodies); in some embodiments, an antigen elicits a cellular response (e.g., involving T-cells whose receptors specifically interact with the antigen). In some embodiments, an antigen binds to an antibody and may or may not induce a particular physiological response in an organism. In general, an antigen may be or include any chemical entity such as, for example, a small molecule, a nucleic acid, a polypeptide, a carbohydrate, a lipid, a polymer (in some embodiments other than a biologic polymer (e.g., other than a nucleic acid or amino acid polymer)) etc. In some embodiments, an antigen is or comprises a polypeptide. In some embodiments, an antigen is or comprises a glycan. Those of ordinary skill in the art will appreciate that, in general, an antigen may be provided in isolated or pure form, or alternatively may be provided in crude form (e.g., together with other materials, for example in an extract such as a cellular extract or other relatively crude preparation of an antigen-containing source), or alternatively may exist on or in a cell. In some embodiments, an antigen is a recombinant antigen.

Antigen presenting cell: The phrase "antigen presenting cell" or "APC," as used herein, has its art understood meaning referring to cells that process and present antigens to T-cells. Exemplary APC include dendritic cells, macrophages, B cells, certain activated epithelial cells, and other cell types capable of TCR stimulation and appropriate T cell costimulation.

Approximately or about: As used herein, the term "approximately" or "about," as applied to one or more values of interest, refers to a value that is similar to a stated reference value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Binding: It will be understood that the term "binding", as used herein, typically refers to a non-covalent association between or among two or more entities. "Direct" binding involves physical contact between entities or moieties; indirect binding involves physical interaction by way of physical contact with one or more intermediate entities. Binding between two or more entities can typically be assessed in any of a variety of contexts—including where interacting entities or moieties are studied in isolation or in the context of more complex systems (e.g., while covalently or otherwise associated with a carrier entity and/or in a biological system or cell).

Cancer: The terms "cancer", "malignancy", "neoplasm", "tumor", and "carcinoma", are used interchangeably herein to refer to cells that exhibit relatively abnormal, uncontrolled, and/or autonomous growth, so that they exhibit an aberrant growth phenotype characterized by a significant loss of control of cell proliferation. In general, cells of interest for detection or treatment in the present application include precancerous (e.g., benign), malignant, pre-metastatic, metastatic, and non-metastatic cells. The teachings of the present disclosure may be relevant to any and all cancers. To give but a few, non-limiting examples, in some embodiments, teachings of the present disclosure are applied to one or more cancers such as, for example, hematopoietic cancers including leukemias, lymphomas (Hodgkins and non-Hodgkins), myelomas and myeloproliferative disorders; sarcomas, melanomas, adenomas, carcinomas of solid tissue, squamous cell carcinomas of the mouth, throat, larynx, and lung, liver cancer, genitourinary cancers such as prostate, cervical, bladder, uterine, and endometrial cancer and renal cell carcinomas, bone cancer, pancreatic cancer, skin cancer, cutaneous or intraocular melanoma, cancer of the endocrine system, cancer of the thyroid gland, cancer of the parathyroid gland, head and neck cancers, breast cancer, gastrointestinal cancers and nervous system cancers, benign lesions such as papillomas, and the like.

Chimeric antigen receptor: "Chimeric antigen receptor" or "CAR" or "CARs" as used herein refers to engineered receptors, which graft an antigen specificity onto cells (for example T cells such as naive T cells, central memory T cells, effector memory T cells or combination thereof). CARs are also known as artificial T-cell receptors, chimeric T-cell receptors or chimeric immunoreceptors. In some embodiments, CARs comprise an antigen-specific targeting regions, an extracellular domain, a transmembrane domain, one or more co-stimulatory domains, and an intracellular signaling domain.

Combination Therapy: As used herein, the term "combination therapy" refers to those situations in which a subject is simultaneously exposed to two or more therapeutic regimens (e.g., two or more therapeutic agents). In some embodiments, two or more agents may be administered simultaneously; in some embodiments, such agents may be administered sequentially; in some embodiments, such agents are administered in overlapping dosing regimens.

Domain: The term "domain" is used herein to refer to a section or portion of an entity. In some embodiments, a "domain" is associated with a particular structural and/or functional feature of the entity so that, when the domain is physically separated from the rest of its parent entity, it substantially or entirely retains the particular structural and/or functional feature. Alternatively or additionally, a domain may be or include a portion of an entity that, when separated from that (parent) entity and linked with a different (recipient) entity, substantially retains and/or imparts on the recipient entity one or more structural and/or functional features that characterized it in the parent entity. In some embodiments, a domain is a section or portion of a molecular (e.g., a small molecule, carbohydrate, a lipid, a nucleic acid, or a polypeptide). In some embodiments, a domain is a section of a polypeptide; in some such embodiments, a domain is characterized by a particular structural element (e.g., a particular amino acid sequence or sequence motif, α-helix character, β-sheet character, coiled-coil character, random coil character, etc), and/or by a particular functional feature (e.g., binding activity, enzymatic activity, folding activity, signaling activity, etc).

Dosage form: As used herein, the terms "dosage form" and "unit dosage form" refer to a physically discrete unit of a therapeutic agent for the patient to be treated. Each unit contains a predetermined quantity of active material calculated to produce the desired therapeutic effect. It will be understood, however, that the total dosage of the composition will be decided by the attending physician within the scope of sound medical judgment.

Dosing regimen: As used herein, the term "dosing regimen" refers to a set of unit doses (typically more than one) that are administered individually to a subject, typically separated by periods of time. In some embodiments, a given therapeutic agent has a recommended dosing regimen, which may involve one or more doses. In some embodiments, a dosing regimen comprises a plurality of doses each of which are separated from one another by a time period of the same length; in some embodiments, a dosing regimen comprises a plurality of doses and at least two different time periods separating individual doses. In some embodiments, all doses within a dosing regimen are of the same unit dose amount. In some embodiments, different doses within a dosing regimen are of different amounts. In some embodiments, a dosing regimen comprises a first dose in a first dose amount, followed by one or more additional doses in a second dose amount different from the first dose amount. In some embodiments, a dosing regimen comprises a first dose in a first dose amount, followed by one or more additional doses in a second dose amount same as the first dose amount. In some embodiments, a dosing regimen is correlated with a desired or beneficial outcome when administered across a relevant population (i.e., is a therapeutic dosing regimen).

Effector Function: As used herein, "effector function" refers a biochemical event that results from the interaction of an antibody Fc region with an Fc receptor or ligand. Effector functions include but are not limited to antibody-dependent cell-mediated cytotoxicity (ADCC), antibody-dependent cell-mediated phagocytosis (ADCP), and complement-mediated cytotoxicity (CMC). In some embodiments, an effector function is one that operates after the binding of an antigen, one that operates independent of antigen binding, or both.

Effector Cell: As used herein, "effector cell" refers to a cell of the immune system that expresses one or more Fc receptors and mediates one or more effector functions. In some embodiments, effector cells may include, but may not be limited to, one or more of monocytes, macrophages, neutrophils, dendritic cells, eosinophils, mast cells, platelets, large granular lymphocytes, Langerhans' cells, natural killer (NK) cells, T-lymphocytes, B-lymphocytes and may be from any organism including but not limited to humans, mice, rats, rabbits, and monkeys.

Expression: As used herein, "expression" of a nucleic acid sequence refers to one or more of the following events: (1) production of an RNA template from a DNA sequence (e.g., by transcription); (2) processing of an RNA transcript (e.g., by splicing, editing, 5' cap formation, and/or 3' end formation); (3) translation of an RNA into a polypeptide or protein; and/or (4) post-translational modification of a polypeptide or protein.

Extracellular domain: As used herein, "extracellular domain" (or "ECD") refers to a portion of a polypeptide that extends beyond the transmembrane domain into extracellular space.

Fusion protein: As used herein, the term "fusion protein" generally refers to a polypeptide including at least two segments, each of which shows a high degree of amino acid identity to a peptide moiety that (1) occurs in nature, and/or (2) represents a functional domain of a polypeptide. Typically, a polypeptide containing at least two such segments is considered to be a fusion protein if the two segments are moieties that (1) are not included in nature in the same peptide, and/or (2) have not previously been linked to one another in a single polypeptide, and/or (3) have been linked to one another through action of the hand of man.

Gene: As used herein, the term "gene" has its meaning as understood in the art. It will be appreciated by those of ordinary skill in the art that the term "gene" may include gene regulatory sequences (e.g., promoters, enhancers, etc.) and/or intron sequences. It will further be appreciated that definitions of gene include references to nucleic acids that do not encode proteins but rather encode functional RNA molecules such as tRNAs, RNAi-inducing agents, etc. For the purpose of clarity we note that, as used in the present application, the term "gene" generally refers to a portion of a nucleic acid that encodes a protein; the term may optionally encompass regulatory sequences, as will be clear from context to those of ordinary skill in the art. This definition is not intended to exclude application of the term "gene" to non-protein-coding expression units but rather to clarify that, in most cases, the term as used in this document refers to a protein-coding nucleic acid.

Gene product or expression product: As used herein, the term "gene product" or "expression product" generally refers to an RNA transcribed from the gene (pre- and/or post-processing) or a polypeptide (pre- and/or post-modification) encoded by an RNA transcribed from the gene.

Immune response: As used herein, the term "immune response" refers to a response elicited in an animal. An immune response may refer to cellular immunity, humoral immunity or may involve both. An immune response may also be limited to a part of the immune system. For example, in certain embodiments, an immunogenic composition may induce an increased IFNγ response. In certain embodiments, an immunogenic composition may induce a mucosal IgA response (e.g., as measured in nasal and/or rectal washes). In certain embodiments, an immunogenic composition may induce a systemic IgG response (e.g., as measured in serum). In certain embodiments, an immunogenic composition may induce virus-neutralizing antibodies or a neutralizing antibody response. In certain embodiments, an immunogenic composition may induce a cytolytic (CTL) response by T cells.

Improve, increase, or reduce: As used herein, the terms "improve," "increase" or "reduce," or grammatical equivalents, indicate values that are relative to a baseline measurement, such as a measurement in the same individual prior to initiation of the treatment described herein, or a measurement in a control individual (or multiple control individuals) in the absence of the treatment described herein.

Individual, subject, patient: As used herein, the terms "subject," "individual" or "patient" refer to a human or a non-human mammalian subject. The individual (also referred to as "patient" or "subject") being treated is an individual (fetus, infant, child, adolescent, or adult) suffering from a disease, for example, cancer. In some embodiments, the subject is a human.

Linker: As used herein, the term "linker" refers to, e.g., in a fusion protein, an amino acid sequence of an appropriate length other than that appearing at a particular position in the natural protein and is generally designed to be flexible and/or to interpose a structure, such as an a-helix, between two protein moieties. In general, a linker allows two or more domains of a fusion protein to retain 50%, 55%, 60%, 65%, 70%, 75%, 80%, 85%, 90%, 95% or more of the biological activity of each of the domains. A linker may also referred to as a spacer.

Masking moiety: As used herein, "masking moiety" refers to a molecular moiety that, when linked to an antigen-binding protein described herein, is capable of masking the binding of such antigen-binding moiety to its target antigen. An antigen-binding protein comprising such a masking moiety is referred to herein as a "masked" antigen-binding protein.

Nucleic acid: As used herein, "nucleic acid", in its broadest sense, refers to any compound and/or substance that is or can be incorporated into an oligonucleotide chain. In some embodiments, a nucleic acid is a compound and/or substance that is or can be incorporated into an oligonucleotide chain via a phosphodiester linkage. As will be clear from context, in some embodiments, "nucleic acid" refers to individual nucleic acid residues (e.g., nucleotides and/or nucleosides); in some embodiments, "nucleic acid" refers to an oligonucleotide chain comprising individual nucleic acid residues. In some embodiments, a "nucleic acid" is or comprises RNA; in some embodiments, a "nucleic acid" is or comprises DNA. In some embodiments, a nucleic acid is, comprises, or consists of one or more natural nucleic acid residues. In some embodiments, a nucleic acid is, comprises, or consists of one or more nucleic acid analogs. In some embodiments, a nucleic acid analog differs from a nucleic acid in that it does not utilize a phosphodiester backbone. For example, in some embodiments, a nucleic acid is, comprises, or consists of one or more "peptide nucleic acids", which are known in the art and have peptide bonds instead of phosphodiester bonds in the backbone, are considered within the scope of the present invention. Alternatively or additionally, in some embodiments, a nucleic acid has one or more phosphorothioate and/or 5'-N-phosphoramidite linkages rather than phosphodiester bonds. In some embodiments, a nucleic acid is, comprises, or consists of one or more natural nucleosides (e.g., adenosine, thymidine, guanosine, cytidine, uridine, deoxyadenosine, deoxythymidine, deoxy guanosine, and deoxycytidine). In some embodiments, a nucleic acid is, comprises, or consists of one or more nucleoside analogs (e.g., 2-aminoadenosine, 2-thiothymidine, inosine, pyrrolo-pyrimidine, 3-methyl adenosine, 5-methylcytidine, C-5 propynyl-cytidine, C-5 propynyl-uridine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, 0(6)-methylguanine, 2-thiocytidine, methylated bases, intercalated bases, and combinations thereof). In some embodiments, a nucleic acid comprises one or more modified sugars (e.g., 2'-fluororibose, ribose, 2'-deoxyribose, arabinose, and hexose) as compared with those in natural nucleic acids. In some embodiments, a nucleic acid has a nucleotide sequence that encodes a functional gene product such as an RNA or protein. In some embodiments, a nucleic acid includes one or more introns. In some embodiments, nucleic acids are prepared by one or more of isolation from a natural source, enzymatic synthesis by polymerization based on a complementary template (in vivo or in vitro), reproduction in a recombinant cell or system, and chemical synthesis. In some embodiments, a nucleic acid is at least 3, 4, 5, 6, 7, 8, 9, 10, 15, 20, 25, 30, 35, 40, 45, 50, 55, 60, 65, 70, 75, 80, 85, 90, 95, 100, 110, 120, 130, 140, 150, 160, 170, 180, 190, 20, 225, 250, 275, 300, 325, 350, 375, 400, 425, 450, 475, 500, 600, 700, 800, 900, 1000, 1500, 2000, 2500, 3000, 3500, 4000, 4500, 5000 or more residues long. In some embodiments, a nucleic acid is single stranded; in some embodiments, a nucleic acid is double stranded. In some embodiments a nucleic acid has a nucleotide sequence comprising at least one element that encodes, or is the complement of a sequence that encodes, a polypeptide. In some embodiments, a nucleic acid has enzymatic activity.

Operably linked: As used herein, "operably linked" refers to a juxtaposition wherein the components described are in a relationship permitting them to function in their intended manner. A control sequence "operably linked" to one or more coding sequence(s) is ligated in such a way that expression of the one or more coding sequence(s) is achieved under conditions compatible with the control sequences. "Operably linked" sequences include both expression control sequences that are contiguous with the gene(s) of interest and expression control sequences that act in trans or at a distance to control the gene(s) of interest. The term "expression control sequence" as used herein refers to polynucleotide sequences that are necessary to effect the expression and processing of coding sequences to which they are ligated. Expression control sequences include appropriate transcription initiation, termination, promoter and enhancer sequences; efficient RNA processing signals such as splicing and polyadenylation signals; sequences that stabilize cytoplasmic mRNA; sequences that enhance translation efficiency (i.e., Kozak consensus sequence); sequences that enhance protein stability; and when desired, sequences that enhance protein secretion. The nature of such control sequences differs depending upon the host organism. For example, in prokaryotes, such control sequences generally include promoter, ribosomal binding site, and transcription termination sequence, while in eukaryotes, typically, such control sequences include promoters and transcription termination sequence. The term "control sequences" is intended to include components whose presence is essential for expression and processing, and can also include additional components whose presence is advantageous, for example, leader sequences and fusion partner sequences.

Patient: As used herein, the term "patient" refers to any organism to which a provided composition is or may be administered, e.g., for experimental, diagnostic, prophylactic, cosmetic, and/or therapeutic purposes. Typical patients include animals (e.g., mammals such as mice, rats, rabbits, non-human primates, and/or humans). In some embodiments, a patient is a human. In some embodiments, a patient is suffering from or susceptible to one or more disorders or conditions. In some embodiments, a patient displays one or more symptoms of a disorder or condition. In some embodiments, a patient has been diagnosed with one or more disorders or conditions. In some embodiments, the disorder or condition is or includes cancer, or presence of one or more tumors. In some embodiments, the patient is receiving or has received certain therapy to diagnose and/or to treat a disease, disorder, or condition.

Peptide: The term "peptide" as used herein refers to a polypeptide that is typically relatively short, for example having a length of less than about 100 amino acids, less than about 50 amino acids, less than 20 amino acids, or less than 10 amino acids.

Pharmaceutically acceptable: The term "pharmaceutically acceptable" as used herein, refers to substances that, within the scope of sound medical judgment, are suitable for use in contact with the tissues of human beings and animals without excessive toxicity, irritation, allergic response, or other problem or complication, commensurate with a reasonable benefit/risk ratio.

Polypeptide: As used herein, a "polypeptide", generally speaking, is a string of at least two amino acids attached to one another by a peptide bond. In some embodiments, a polypeptide may include at least 3-5 amino acids, each of which is attached to others by way of at least one peptide bond. Those of ordinary skill in the art will appreciate that polypeptides sometimes include "non-natural" amino acids or other entities that nonetheless are capable of integrating into a polypeptide chain, optionally.

Promoter: As used herein, a "promoter" is a DNA sequence recognized by the synthetic machinery of the cell, or introduced synthetic machinery, required to initiate the specific transcription of a polynucleotide sequence. A "constitutive" promoter is a nucleotide sequence which, when operably linked with a polynucleotide that encodes or specifies a gene product, causes the gene product to be produced in a cell under most or all physiological conditions of the cell. An "inducible" promoter is a nucleotide sequence that, when operably linked with a polynucleotide that encodes or specifies a gene product, causes the gene product to be produced in a cell substantially only when a promoter-specific inducer is present in the cell.

Protein: As used herein, the term "protein", refers to a polypeptide (i.e., a string of at least two amino acids linked to one another by peptide bonds). Proteins may include moieties other than amino acids (e.g., may be glycoproteins, proteoglycans, etc.) and/or may be otherwise processed or modified. Those of ordinary skill in the art will appreciate that a "protein" can be a complete polypeptide chain as produced by a cell (with or without a signal sequence), or can be a portion thereof. Those of ordinary skill will appreciate that a protein can sometimes include more than one polypeptide chain, for example linked by one or more disulfide bonds or associated by other means. Polypeptides may contain L-amino acids, D-amino acids, or both and may contain any of a variety of amino acid modifications or analogs known in the art. Useful modifications include, e.g., terminal acetylation, amidation, methylation, etc. In some embodiments, proteins may comprise natural amino acids, non-natural amino acids, synthetic amino acids, and combinations thereof.

Reference: As used herein, "reference" describes a standard or control relative to which a comparison is performed. For example, in some embodiments, an agent, animal, individual, population, sample, sequence or value of interest is compared with a reference or control agent, animal, individual, population, sample, sequence or value. In some embodiments, a reference or control is tested and/or determined substantially simultaneously with the testing or determination of interest. In some embodiments, a reference or control is a historical reference or control, optionally embodied in a tangible medium. Typically, as would be understood by those skilled in the art, a reference or control is determined or characterized under comparable conditions or circumstances to those under assessment. Those skilled in the art will appreciate when sufficient similarities are present to justify reliance on and/or comparison to a particular possible reference or control.

Solid tumor: As used herein, the term "solid tumor" refers to an abnormal mass of tissue that usually does not contain cysts or liquid areas. Solid tumors may be benign or malignant. Different types of solid tumors are named for the type of cells that form them. Examples of solid tumors are sarcomas, carcinomas, lymphomas, mesothelioma, neuroblastoma, retinoblastoma, etc.

Stage of cancer: As used herein, the term "stage of cancer" refers to a qualitative or quantitative assessment of the level of advancement of a cancer. Criteria used to determine the stage of a cancer include, but are not limited to, the size of the tumor and the extent of metastases (e.g., localized or distant).

Subject: By "subject" is meant a mammal (e.g., a human, in some embodiments including prenatal human forms). In some embodiments, a subject is suffering from a relevant disease, disorder or condition. In some embodiments, a subject is susceptible to a disease, disorder, or condition. In some embodiments, a subject displays one or more symptoms or characteristics of a disease, disorder or condition. In some embodiments, a subject does not display any symptom or characteristic of a disease, disorder, or condition. In some embodiments, a subject is someone with one or more features characteristic of susceptibility to or risk of a disease, disorder, or condition. In some embodiments, a subject is a patient. In some embodiments, a subject is an individual to whom diagnosis and/or therapy is and/or has been administered.

Suffering from: An individual who is "suffering from" a disease, disorder, or condition (e.g., cancer) has been diagnosed with and/or exhibits one or more symptoms of the disease, disorder, or condition.

Symptoms are reduced: According to the present invention, "symptoms are reduced" when one or more symptoms of a particular disease, disorder or condition is reduced in magnitude (e.g., intensity, severity, etc.) or frequency. For purposes of clarity, a delay in the onset of a particular symptom is considered one form of reducing the frequency of that symptom. It is not intended that the present invention be limited only to cases where the symptoms are eliminated. The present invention specifically contemplates treatment such that one or more symptoms is/are reduced (and the condition of the subject is thereby "improved"), albeit not completely eliminated.

T cell receptor: As used herein, a "T cell receptor" or "TCR" refers to the antigen-recognition molecules present on the surface of T-cells. During normal T-cell development, each of the four TCR genes, $\alpha$, $\beta$, $\gamma$, and $\delta$, can rearrange leading to highly diverse TCR proteins.

Therapeutic agent: As used herein, the phrase "therapeutic agent" in general refers to any agent that elicits a desired pharmacological effect when administered to an organism. In some embodiments, an agent is considered to be a therapeutic agent if it demonstrates a statistically significant effect across an appropriate population. In some embodiments, the appropriate population may be a population of model organisms. In some embodiments, an appropriate population may be defined by various criteria, such as a certain age group, gender, genetic background, preexisting clinical conditions, etc. In some embodiments, a therapeutic agent is a substance that can be used to alleviate, ameliorate, relieve, inhibit, prevent, delay onset of, reduce severity of, and/or reduce incidence of one or more symptoms or features of a disease, disorder, and/or condition. In some embodiments, a "therapeutic agent" is an agent that has been or is required to be approved by a government agency before it can be marketed for administration to humans. In some embodiments, a "therapeutic agent" is an agent for which a medical prescription is required for administration to humans.

Therapeutically effective amount: As used herein, the term "therapeutically effective amount" means an amount that is sufficient, when administered to a population suffering from or susceptible to a disease, disorder, and/or condition in accordance with a therapeutic dosing regimen, to treat the disease, disorder, and/or condition. In some embodiments, a therapeutically effective amount is one that reduces the incidence and/or severity of, stabilizes one or more characteristics of, and/or delays onset of, one or more symptoms of the disease, disorder, and/or condition. Those of ordinary skill in the art will appreciate that the term "therapeutically effective amount" does not in fact require successful treatment be achieved in a particular individual. Rather, a therapeutically effective amount may be that amount that provides a particular desired pharmacological response in a significant number of subjects when administered to patients in need of such treatment. For example, in some embodiments, "therapeutically effective amount" refers to an amount which, when administered to an individual in need thereof in the context of inventive therapy, will block, stabilize, attenuate, or reverse a cancer-supportive process occurring in said individual, or will enhance or increase a cancer-suppressive process in said individual. In the context of cancer treatment, a "therapeutically effective amount" is an amount which, when administered to an individual diagnosed with a cancer, will prevent, stabilize, inhibit, or reduce the further development of cancer in the individual. A particularly preferred "therapeutically effective amount" of a composition described herein reverses (in a therapeutic treatment) the development of a malignancy such as a pancreatic carcinoma or helps achieve or prolong remission of a malignancy. A therapeutically effective amount administered to an individual to treat a cancer in that individual may be the same or different from a therapeutically effective amount administered to promote remission or inhibit metastasis. As with most cancer therapies, the therapeutic methods described herein are not to be interpreted as, restricted to, or otherwise limited to a "cure" for cancer; rather the methods of treatment are directed to the use of the described compositions to "treat" a cancer, i.e., to effect a desirable or beneficial change in the health of an individual who has cancer. Such benefits are recognized by skilled healthcare providers in the field of oncology and include, but are not limited to, a stabilization of patient condition, a decrease in tumor size (tumor regression), an improvement in vital functions (e.g., improved function of cancerous tissues or organs), a decrease or inhibition of further metastasis, a decrease in opportunistic infections, an increased survivability, a decrease in pain, improved motor function, improved cognitive function, improved feeling of energy (vitality, decreased malaise), improved feeling of well-being, restoration of normal appetite, restoration of healthy weight gain, and combinations thereof. In addition, regression of a particular tumor in an individual (e.g., as the result of treatments described herein) may also be assessed by taking samples of cancer cells from the site of a tumor such as a pancreatic adenocarcinoma (e.g., over the course of treatment) and testing the cancer cells for the level of metabolic and signaling markers to monitor the status of the cancer cells to verify at the molecular level the regression of the cancer cells to a less malignant phenotype. For example, tumor regression induced by employing the methods of this invention would be indicated by finding a decrease in one or more pro-angiogenic markers, an increase in anti-angiogenic markers, the normalization (i.e., alteration toward a state found in normal individuals not suffering from cancer) of metabolic pathways, intercellular signaling pathways, or intracellular signaling pathways that exhibit abnormal activity in individuals diagnosed with cancer. Those of ordinary skill in the art will appreciate that, in some embodiments, a therapeutically effective amount may be formulated and/or administered in a single dose. In some embodiments, a therapeutically effective amount may be formulated and/or administered in a plurality of doses, for example, as part of a dosing regimen.

Transformation: As used herein, "transformation" refers to any process by which exogenous DNA is introduced into a host cell. Transformation may occur under natural or artificial conditions using various methods well known in the art. Transformation may rely on any known method for the insertion of foreign nucleic acid sequences into a prokaryotic or eukaryotic host cell. In some embodiments, a particular transformation methodology is selected based on the host cell being transformed and may include, but is not limited to, viral infection, electroporation, mating, lipofection. In some embodiments, a "transformed" cell is stably transformed in that the inserted DNA is capable of replication either as an autonomously replicating plasmid or as part of the host chromosome. In some embodiments, a transformed cell transiently expresses introduced nucleic acid for limited periods of time.

Treatment: As used herein, the term "treatment" (also "treat" or "treating") refers to any administration of a substance that partially or completely alleviates, ameliorates, relives, inhibits, delays onset of, reduces severity of, and/or reduces incidence of one or more symptoms, features, and/or causes of a particular disease, disorder, and/or condition (e.g., cancer). Such treatment may be of a subject who does not exhibit signs of the relevant disease, disorder and/or condition and/or of a subject who exhibits only early signs of the disease, disorder, and/or condition. Alternatively or additionally, such treatment may be of a subject who exhibits one or more established signs of the relevant disease, disorder and/or condition. In some embodiments, treatment may be of a subject who has been diagnosed as suffering from the relevant disease, disorder, and/or condition. In some embodiments, treatment may be of a subject known to have one or more susceptibility factors that are statistically correlated with increased risk of development of the relevant disease, disorder, and/or condition.

Tumor infiltrating lymphocyte: As used herein, the term "tumor-infiltrating lymphocytes" refers to white blood cells of a subject afflicted with a cancer (such as melanoma), that have left the blood stream and have migrated into a tumor. In some embodiments, tumor-infiltrating lymphocytes have tumor specificity.

Vector: As used herein, "vector" refers to a nucleic acid molecule capable of transporting another nucleic acid to which it is associated. In some embodiments, vectors are capable of extra-chromosomal replication and/or expression of nucleic acids to which they are linked in a host cell such as a eukaryotic and/or prokaryotic cell. Vectors capable of directing the expression of operatively linked genes are referred to herein as "expression vectors."

DETAILED DESCRIPTION

Among other things, the present invention provides methods and compositions useful for treatment of cancer. Specifically, the present disclosure provides cellular therapeutics, e.g., immune cells, genetically modified with an integrated gene, e.g., a nucleotide sequence of interest (e.g., a constitutive expression construct and/or an inducible expression construct that includes such nucleotide sequence). In some embodiments, expression of a nucleotide sequence of interest can be designed to be constitutive or inducible by appropriate selection, construction and/or design of an expressed promoter sequence operably linked to such nucleotide sequence of interest, as described herein. In the case of a constitutive expression construct, a gene in the construct is constitutively expressed. In the case of an inducible expression construct, a cellular therapeutic can be genetically modified with a nucleic acid encoding an antigen binding receptor and with an inducible expression construct. Upon binding of a target antigen, an antigen binding receptor of a cellular therapeutic induces expression of a gene included in an inducible expression construct, e.g., as depicted in FIG. 1. In certain embodiments, expression of such gene facilitates and/or improves treatment of cancer, e.g., by one or more cellular therapies. The invention also specifically discloses protein therapeutics that include proteins encoded by such genes (e.g., soluble forms of such gene products, e.g., pharmaceutical compositions that include such proteins for administration), and nucleic acids encoding such proteins, such as for gene therapy.

Constitutive Expression Constructs

In some embodiments, the disclosure includes constitutive expression constructs. In some embodiments, a constitutive expression construct comprises a nucleic acid sequence that includes at least a promoter operably linked to a nucleotide sequence of interest, e.g., a gene described herein. A constitutive expression construct can comprise regulatory sequences, such as transcription and translation initiation and termination codons. In some embodiments, such regulatory sequences are specific to the type of cell into which the non-inducible expression construct is to be introduced, as appropriate. A constitutive expression construct can comprise a native or non-native promoter operably linked to a nucleotide sequence of interest. Preferably, the promoter is functional in immune cells. Exemplary promoters include, e.g., CMV, E1F, VAV, TCRvbeta, MCSV, and PGK promoter. Operably linking of a nucleotide sequence with a promoter is within the skill of the artisan. In some embodiments, a constitutive expression construct is or includes a recombinant expression vector described herein.

Inducible Expression Constructs and Inducible Expression

For inducible expression, a cellular therapeutic of the present disclosure can include (i) one or more types of antigen binding receptors comprising an extracellular domain, a transmembrane domain, and an intracellular (or cytoplasmic) domain, and (ii) an inducible expression construct.

Antigen Binding Receptors

The extracellular domain of an antigen binding receptor comprises a target-specific antigen binding domain. The intracellular domain (or cytoplasmic domain) of an antigen binding receptor comprises a signaling domain. The signaling domain includes an amino acid sequence that, upon binding of target antigen to the antigen binding domain, initiates and/or mediates an intracellular signaling pathway that can activate, among other things, an inducible expression construct described herein, such that an inducible gene is expressed. In some embodiments, a signaling domain further includes one or more additional signaling regions (e.g., costimulatory signaling regions) that activate one or more immune cell effector functions (e.g., native immune cell effector functions). In some embodiments, the signaling domain activates T cell activation, proliferation, survival, or other T cell function, but does not induce cytotoxic activity. In some embodiments, an antigen binding receptor includes all or part of a chimeric antigen receptor (CAR). Such CARs are known in the art (see, e.g., Gill et al., Immunol. Rev. 263:68-89 (2015); Stauss et al., Curr. Opin. Pharmacol. 24:113-118 (2015)).

Antigen Binding Domain

An antigen binding domain can be or include any polypeptide that specifically binds to a target antigen, e.g., a tumor antigen described herein. For example, in some embodiments, an antigen binding domain includes an antibody or antigen-binding fragment described herein (e.g., an Fab fragment, Fab' fragment, F(ab')$_2$ fragment, scFv fragment, Fv fragment, dsFv diabody, dAb fragment, Fd' fragment, Fd fragment, an isolated complementarity determining region (CDR), a cameloid antibody, a masked antibody (e.g., Probody®), a single chain or Tandem diabody (TandAb®), a VHH, an Anticalin®, a single-domain antibody (e.g., Nanobody®), an ankyrin repeat protein or DARPIN®, an Avimer®, an Adnectin®, an Affilin®, an Affibody®, a Fynomer®, or a Centyrin®). In some embodiments, an antigen binding domain is or includes a T cell receptor (TCR) or antigen-binding portion thereof. In some embodiments, an antigen binding domain is a pH sensitive domain (see, e.g., Schroter et al., MAbs 7:138-51 (2015)).

Antigen binding domains can be selected based on, e.g., type and number of target antigens present on or near a surface of a target cell. For example, an antigen binding domain can be chosen to recognize an antigen that acts as a cell surface marker on a target cell associated with a particular disease state. In some embodiments, an antigen binding domain is selected to specifically bind to an antigen on a tumor cell. Tumor antigens are proteins that are produced by tumor cells and, in some embodiments, that elicit an immune response, particularly T-cell mediated immune responses. Selection of an antigen binding domain can depend on, e.g., a particular type of cancer to be treated.

Transmembrane Domain

In general, a "transmembrane domain", as used herein, refers to a domain having an attribute of being present in the membrane (e.g., spanning a portion or all of a cellular membrane). As will be appreciated, it is not required that every amino acid in a transmembrane domain be present in the membrane. For example, in some embodiments, a transmembrane domain is characterized in that a designated stretch or portion of a protein is substantially located in the membrane. As is well known in the art, amino acid or nucleic acid sequences may be analyzed using a variety of algorithms to predict protein subcellular localization (e.g., transmembrane localization). Exemplary such programs include psort (PSORT.org), Prosite (prosite.expasy.org), among others.

The type of transmembrane domain included in an antigen binding receptor described herein is not limited to any particular type. In some embodiments, a transmembrane domain is selected that is naturally associated with an antigen binding domain and/or intracellular domain. In some instances, a transmembrane domain includes a modification of one or more amino acids (e.g., deletion, insertion, and/or substitution), e.g., to avoid binding of such domains to a transmembrane domain of the same or different surface membrane proteins to minimize interactions with other members of the receptor complex.

A transmembrane domain can be derived either from a natural or from a synthetic source. Where the source is natural, a domain may be derived from any membrane-bound or transmembrane protein. Exemplary transmembrane regions can be derived from (e.g., can comprise at least a transmembrane region(s) of) an alpha, beta or zeta chain of a T-cell receptor, CD28, CD3 epsilon, CD45, CD4, CD5, CD8, CD9, CD16, CD22, CD27, CD33, CD37, CD64, CD80, CD86, CD134, CD137, TNFSFR25, or CD154. Alternatively, a transmembrane domain can be synthetic (and can, e.g., comprise predominantly hydrophobic residues such as leucine and valine). In some embodiments, a triplet of phenylalanine, tryptophan and valine are included at each end of a synthetic transmembrane domain. In some embodiments, a transmembrane domain is directly linked to a cytoplasmic domain. In some embodiments, a short oligo- or polypeptide linker (e.g., between 2 and 10 amino acids in length) may form a linkage between a transmembrane domain and an intracellular domain. In some embodiments, a linker is a glycine-serine doublet.

Cytoplasmic Domain

The intracellular domain (or cytoplasmic domain) comprises a signaling domain that, upon binding of target antigen to the antigen binding domain, initiates and/or mediates an intracellular signaling pathway that induces expression of an inducible expression construct described herein.

Intracellular signaling domains that can transduce a signal upon binding of an antigen to an immune cell are known, any of which can be used herein. For example, cytoplasmic sequences of a T cell receptor (TCR) are known to initiate signal transduction following TCR binding to an antigen (see, e.g., Brownlie et al., Nature Rev. Immunol. 13:257-269 (2013)). In some embodiments, a signaling domain includes an immunoreceptor tyrosine-based activation motif (ITAM). Examples of ITAM containing cytoplasmic signaling sequences include those derived from TCR zeta, FcR gamma, FcR beta, CD3 zeta, CD3 gamma, CD3 delta, CD3 epsilon, CD5, CD22, CD79a, CD79b, and CD66d (see, e.g., Love et al., Cold Spring Harb. Perspect. Biol. 2:a002485 (2010); Smith-Garvin et al., Annu. Rev. Immunol. 27:591-619 (2009)).

In some embodiments, an intracellular signaling domain does not include a sequence that transduces a signal leading to killing by T cells (e.g., $CD8^+$ T cells). For example, TCR cytoplasmic sequences are known to activate a number of signaling pathways, some of which lead to killing (see, e.g., Smith-Garvin et al., Annu. Rev. Immunol. 27:591-619 (2009)). In some embodiments, an intracellular domain includes a signaling domain that leads to signal transduction that mediates expression of an inducible expression construct, but not induction of killing (e.g., as exemplified in FIG. 6). For example, the cytoplasmic domain can include a cytoplasmic portion of a PDGF receptor and, upon antigen binding by the antigen binding domain, can lead to an intracellular signal that induces a promoter of the inducible expression construct. One of skill in the art, based on knowledge in the art, can select an intracellular domain and a cognate promoter to be included within an inducible expression construct.

It is known that signals generated through a TCR alone are insufficient for full activation of a T cell and that a secondary or co-stimulatory signal is also required. Thus, in some embodiments, a signaling domain further includes one or more additional signaling regions (e.g., costimulatory signaling regions) that activate one or more immune cell effector functions (e.g., a native immune cell effector function described herein). In some embodiments, a portion of such costimulatory signaling regions can be used, as long as the portion transduces the effector function signal. In some embodiments, a cytoplasmic domain described herein includes one or more cytoplasmic sequences of a T cell co-receptor (or fragment thereof). Non-limiting examples of such T cell co-receptors include CD27, CD28, 4-1BB (CD137), OX40, CD30, CD40, PD-1, ICOS, lymphocyte function-associated antigen-1 (LFA-1), MYD88, CD2, CD7, LIGHT, NKG2C, B7-H3, and a ligand that specifically binds with CD83.

In some embodiments, two or more signaling domains are linked to each other in a random or specified order. Optionally, a short oligo- or polypeptide linker, (e.g., between 2 and 10 amino acids in length) may form the linkage. In some embodiments, such linker is a glycine-serine doublet.

Exemplary Antigen Binding Receptors

In some embodiments, a transmembrane and/or cytoplasmic domain is derived from a receptor tyrosine kinase (RTK). RTKs are a large and diverse family of cell surface receptors that transmit signals that trigger various physiologic responses depending on cell type and signal integration from the cell surface. Many RTKs are suitable to transmit signals in T cells, as the downstream components for signaling widely shared across cell types (Schlessinger, J. 2000. Cell Signaling by Receptor Review Tyrosine Kinases Cell 103, 211-225). The example given below is directed to PDGF receptors. These receptors are exemplary, and other receptor pairs, e.g., SCF—R and c-kit, and other heterodimeric and homodimeric receptors, can also be used.

RTKs are divided into subfamilies based on the manner in which the receptors signal in response to ligand binding. One example is the PDGFR family (Type III RTKs) that contains the two PDGF receptors (PDGFR-alpha (α) and PDGFR-beta (β)), CSF1R, KIT, RK2 and FLT3. These receptors signal upon dimerization that is induced by ligand binding—the ligands being members of the PDGF family. The receptors can signal as homodimers (αα and ββ) and as the heterodimer (4) (Wu E, Palmer N, Tian Z, Moseman A P, Galdzicki M, et al. (2008) Comprehensive Dissection of PDGF-PDGFR Signaling Pathways in PDGFR Genetically Defined Cells. PLoS ONE 3: e3794. doi: 10.1371/journal.pone.0003794). PDGFRs and several other TYPE III RTKs are dysregulated in some T cell malignancies, and other hematologic malignancies, illustrating their potential to signal proliferation and survival without triggering cytotoxic activity (Wadleigh M, DeAngelo D J, Griffin J D, Stone R M. 2005. After chronic myelogenous leukemia: tyrosine kinase inhibitors in other hematologic malignancies. Blood. 105, 22-30; Blood. 2010 Jan. 7; 115(1): 51-60; Yang, J. et al. Platelet-derived growth factor mediates survival of leukemic large granular lymphocytes via an autocrine regulatory pathway. doi: 10.1182/blood-2009-06-223719). Importantly, mutations in PDGFRs can cause the receptors to signal in an autocrine manner, that is, independently of dimerization induced by ligand binding. This autocrine signaling is caused by mutations in the protein sequence, and has been shown to require only the transmembrane (TM) and cytoplasmic domains of the PDGFR. Thus, the PDGFR receptors are one example of RTKs useful for designing CAR-T signaling domains.

In some embodiments, a TM and/or cytoplasmic domain of PDGFRα and/or PDGFRβ, can be used as signaling domains. In one embodiment, a T cell is tranfected with nucleotide sequences encoding an scFv directed to CD19 (e.g., as can be derived from antibody FMC63) cloned in frame with nucleotide sequence encoding a TM and cytoplasmic domain of a PDGFR, e.g. PDGFRβ, with suitable linker sequences inserted between the components. The resulting CAR-T cell expresses anti-CD19 scFv as an antigen binding domain, and recognition of CD19 on cells (e.g., normal B cells or malignant B cells) induces CAR-T cell activation and proliferation, and supports cells survival, but does not induce cytotoxicity. These qualities of PDGFRβ signaling are known in T cell malignancies, and other hematologic malignancies, in which PDGFRβ is dysregulated, e.g., Chronic Myelogenous Leukemia (CIVIL) and T cell leukemia. The binding of antigen to the antigen binding domain (scFv) induces PDGFR dimerization. In some embodiments, scFv is assessed for ability to specifically induce PDGFR dimerization, an can be determined by known signaling assays and functional assays.

In some embodiments, a consequence of CAR-T cell activation and proliferation is stimulation of specific promoters, e.g., a promoter described herein, e.g., the CD69 promoter, the CD25 promoter, the TNF promoter, the VLA1 promoter, the LFA1 promoter, and many others described herein (see, e.g., Example 9), and can lead to expression of an inducible expression construct described herein. In some embodiments, upon binding of antigen (e.g., CD19) to a first antigen binding receptor (e.g., that includes an anti-CD19 scFv as an antigen binding domain and a transmembrane and/or cytoplasmic domain of PDGFR) an inducible expression construct encoding a second antigen binding receptor is induced to be expressed. This second, induced, antigen binding receptor can bind to a tumor antigen of interest, and can include a canonical CAR-T signaling domain described herein, e.g., CD3/CD28 or CD3/4-1BB or CD3/CD28/4-1BB. Thus, such an exemplary CAR-T cell has two activities: the first is T cell activation, proliferation and survival, as induced by signaling through the first antigen binding receptor (that includes an anti-CD19 scFv as an antigen binding domain and a transmembrane and/or cytoplasmic domain of PDGFR); and the second is canonical T cell activation, proliferation, survival and anti-tumor cell cytotoxic activity, where the tumor cell is identified by the target of the induced antigen binding receptor.

In another embodiment, PDGFRα TM and cytoplasmic domains are used in place of PDGFRβ TM and cytoplasmic domains. In yet another embodiment, nucleic acid sequences encoding an anti-CD19 scFv linked to PDGFRα TM and/or cytoplasmic domains, and anti-CD19 scFv linked to PDGFRβ TM and/or cytoplasmic domains, are expressed in T cells such that a T cell expresses heterodimeric CAR constructs consisting of both the PDGFRα and PDGFRβ TM and cytoplasmic domains. Empirical analyses of CAR-mediated signaling and T cell function in response to antigen (e.g. CD19) can be used to identify appropriate PDGFR TM and cytoplasmic domains representing PDGFRα and PDGFRβ (e.g., domains that induce T cell proliferation and survival, but not cytotoxic activity, in response to antigen, e.g., as displayed on antigen-positive cells).

In another embodiment, a cytoplasmic domain of PDGFRα and/or PDGFRβ is mutagenized to enhance or reduce one or more components of downstream signaling in order to induce T cell activation, proliferation and survival, but not cytotoxic activity, in response to antigen, e.g. as displayed on antigen-positive cells. Techniques for mutagenesis and subsequent analyses are well-known and readily apparent to one skilled in the art. In another embodiment, a cytoplasmic domain of PDGFRα and/or PDGFRβ is mutagenized to enhance or reduce one or more components of downstream signaling in order to optimize induction of a specific promoter, e.g., a promoter described herein, e.g., CD69 promoter, CD25 promoter, and/or as described in Example 9.

In another embodiment, a T cell (i) expresses a first antigen binding receptor (e.g., that includes an scFv as an antigen binding domain and a transmembrane and/or cytoplasmic domain of PDGFR), where the scFv is directed to a first tumor antigen expressed on a tumor type, and (ii) upon binding of the first antigen binding receptor to the first tumor antigen, the T cell is induced to express a second antigen binding receptor that includes an scFv directed to a second tumor antigen expressed on the same tumor type. In some embodiments, the first antigen binding receptor signals T cell activation, proliferation and survival, but not cytotoxic activity, and the induced antigen binding receptor (i.e., the second antigen binding receptor) triggers cytoxicity. In some such embodiments, a T cell allows 'antigen-gating', whereby cytoxicity is induced only when both antigens are successfully encountered, while still promoting CAR T cell expansion and persistence. Such embodiments can be useful, e.g., where engagement of a single antigen provides an insufficient therapeutic window over normal cell (i.e., non-malignant cell) destruction and on-target toxicity. Examples of such 'antigen pairs' to which a first and second antigen binding receptor can be directed include, but are not limited to, CD56 and CD138, CD56 and BCMA, CD138 and BCMA (Multiple Myeloma), IL-3R (CD123) and CD33, CD123 and CLEC12A, CD33 and CLEC12A (Acute Myeloid Leukemia), CD56 and c-KIT (e.g. Small Cell Lung Cancer), CEA and PSMA, PSCA and PSMA, CEA and PSCA (Pancreatic Cancer), CA-IX and CD70 (Renal Cell Carcinoma), HER2 and EGFR, Epcam and c-MET, EGFR and IGFR (e.g. for Breast Cancer), MUC16 and Folate Receptor alpha, Mesothelin and Folate Receptor alpha (e.g. Ovarian Cancer, Mesothelioma), and many others. In some examples one might choose to target the tumor microenvironment (TME), e.g. tumor-associated macrophages (TAM) or myeloid-derived suppressor cells (MDSC) or tumor-associated fibroblasts. Examples of relevant targeting antigen pairs include but are not limited to: FAP and CD45, FAP and CSFR1, and CD45 and CSFR1.

In another embodiment, a T cell (i) expresses a first antigen binding receptor (e.g., that includes a bispecific antibody (or portion) as an antigen binding domain and a transmembrane and/or cytoplasmic domain of PDGFR), where the bispecific antibody (or portion) binds a B cell antigen (e.g., CD19) and to a tumor antigen expressed on a tumor of interest, and (ii) upon binding of the first antigen binding receptor to the first tumor antigen, the T cell is induced to express a second antigen binding receptor that includes an scFv directed to a second tumor antigen expressed on the same tumor type. In some embodiments, the first antigen binding receptor utilizes both CD19 recognition (to facilitate expansion and/or persistence) and 'antigen-pair' recognition to facilitate expansion, persistence and/or cytotoxicity. Examples of such 'antigen pairs' include but are not limited to, CD56 and CD138, CD56 and BCMA, CD138 and BCMA (Multiple Myeloma), IL-3R (CD123) and CD33 (Acute Myeloid Leukemia), CD56 and c-KIT (e.g. Small Cell Lung Cancer), CEA and PSMA, PSCA and PSMA, CEA and PSCA (Pancreatic Cancer), CA-IX and CD70 (Renal Cell Carcinoma), HER2 and EGFR, Epcam and c-MET, EGFR and IGFR (e.g. for Breast Cancer), MUC16 and Folate Receptor alpha, Mesothelin and Folate Receptor alpha (e.g. Ovarian Cancer, Mesothelioma), and many others. In some examples one might choose to target the tumor microenvironment (TME), e.g. tumor-associated macrophages (TAM) or myeloid-derived suppressor cells (MDSC) or tumor-associated fibroblasts. Examples of relevant targeting antigen pairs include but are not limited to: FAP and CD45, FAP and CSFR1, and CD45 and CSFR1.

Domains of other receptors in the Type III RTK family, e.g., CSF1R, KIT, RK2 and FLT3, can be included in antigen binding receptors described herein. The disclosure is not limited to the Type III RTK family, but is readily applied to the TM and cytoplasmic domains of other RTK families and receptors, e.g. the Epidermal growth factor receptor family, the Fibroblast growth factor receptor (FGFR) family, the Vascular endothelial growth factor receptor (VEGFR) family, the RET receptor family, the Eph receptor family, or the Discoidin domain receptor (DDR) family and many other as comprise receptors and families within the RTK families I-XVII. Constructs described herein can be modified to account for the different physiological means used within the different RTK families to trigger receptor signaling.

In some embodiments, a transmembrane and/or cytoplasmic domain is derived from one or more components of a JAK/STAT pathway. The JAK family of signaling proteins consists of JAK1, JAK3, JAK3 and TYK2. JAK proteins homodimerize and heterodimerize in order to phosphorylate STAT proteins. The STAT proteins thus propagate signaling. The STAT family consists of STATs 1-6. A regulatory form of STAT5, called STAT5b, has also been identified. Nearly all JAK/STAT combinations may be possible, although specific cell surface receptors are known to utilize subsets of JAKs and STATs when signaling.

Hematologic malignancies provide several examples of dysregulated JAK/STAT signaling cascades that can support cell proliferation and survival. The myeloid cell disorders, polycythemia vera (PV), essential thrombocythemia (ET) and primary myelofibrosis (PMF) demonstrate mutations in JAK2 signaling, which can lead to constitutive STAT3 and/or STAT5 activation. The mutations most often appear in the pseudokinase domain impacting JAK signaling and its regulation. The genotype/phenotype relationship is complex and demonstrates a gene dosage effect such that a single allele ghenotype generally has a different outcome that a dual allele genotype (e.g. development of ET vs PV). Both JAK2 and JAK1 have been identified as driver mutations in T cell leukemias, and activation of STAT proteins has been implicated in a variety of T cell leukemias and lymphomas. Somatic mutations in the JAK3 gene are seen in acute lymphoblastic and acute myelogenous leukemia, and in multiple myeloma and non-Hodgkin lymphoma. Oncogenic mutations in various regulatory and negative feedback pathways that control JAK/STAT signaling have also been described. These examples provide evidence of proliferative T cell activation driven by JAK/STAT pathways, albeit pathogenic activation when subjected to malignant mutations.

Many receptors are known signal through JAK/STAT complexes. Among the RTKs, the IGF-Rs, the EGFR/ErbB receptors, SCFR/cKit, BDNF, EphA4, VEGFR/Flt-1 and HGFR/c-Met preferentially utilize JAK 1 and/or 2 and various combinations of STATs 1, 3 and 5. The RTKs also induce many other signaling cascades. The hormone receptors (GHR, TpoR, EpoR, Prolactin-R) also preferentially utilize JAK 1 and/or 2 (homodimers and heterodimers) and various combinations of STATs 1, 3 and 5. The TpoR can also signal through TYK2 via a JAK2/TYK2 complex). The principal signaling pathway activated by the Prolactin-Receptor pathway is the JAK/STAT pathway. The ligand (Prolactin) binds and induces receptor dimerization and JAK2 activation. JAK2 is constitutively associated with the Prolactin receptor. JAK2 phosphorylates receptor cytoplasmic domain tyrosine residues and enables STAT protein binding and phosphorylation. Phosphorylated STAT5 dissociates from the receptor, dimerizes, undergoes nuclear translocation and target gene promoter activation. The prolactin receptor also signals through ZAP70, Tec, PTK2, Fyn, NF—KB and MAPK. The prolactin receptor is active in lymphocytes and this activity is associated with lymphocyte survival during activation.

Cytokine receptors of the common beta chain and common gamma chain receptor families singularly use the JAK/STAT pathways to transduce signals upon ligand (i.e. cytokine) binding. In all cases, ligand binding and receptor signaling requires the formation of a heteromeric complex between and specific alpha chain and the common (beta or gamma) chain. Within the common beta chain family (IL-3, IL-5, GM-CSF) the IL-5Ralpha/common beta chain complex signals through JAKs 1 and 2 and STATs 3 and 5, while the GM-CSF-Ralpha/common beta chain complex utilizes JAKs 1 and 2 to signal through STATs 1, 3, 5 and 6. Within the common gamma chain family (IL-2, IL-4, IL-7, IL-9, IL-13, IL-21) JAK3 is typically engaged, along with JAK1 and/or 2 and/or TYK2. As a consequence STAT signaling is varied. The related cytokine TSLP shows restricted JAK utilization, as it signals through an IL-7Ralpha/TSLP-R complex to JAKs 1 and 2, and STATs 1, 3 and 5.

The IL-6 receptor family, the IL-10 receptor family and the IL-12 receptor family all share similar features. The receptors form heteromeric complexes consisting of variously shared alpha chains (e.g. IL-20R alpha), beta chains (e.g. IL-10R beta), lambda chains (e.g. IFN-lambda-R1), or a receptor-specific chain and the gp130 coreceptor. This modularity allows for considerable variety in ligand/receptor interactions and JAK/STAT signaling. All of the receptor complexes within these three cytokine receptor families utilize JAK1 and JAK2 and TYK2, or a subset thereof, and in most cases STATs 1, 3, and 5 are the phosphorylated targets of the JAK activity, with a few exceptions. The utilization of TYK2 often engages additional STAT proteins, such as STATs 4 and 6. A very similar pattern is seen within the G-protein coupled receptors that signal through a JAK/STAT pathway (e.g. 5-HT2A, AGTR-1, various chemokine receptors).

The IL-6 receptor (IL-6R alpha/gp130) engages JAK complexes containing JAK1, JAK2, and TYK2. These in turn signal through STAT1 and STAT5. In T cells IL-6 receptor signaling fosters cell proliferation, survival, differentiation and protection from T-regulatory cell mediated suppression. The leptin receptor signals primarily through JAK2 and STAT3 and STAT5 to induce both proliferative and anti-apoptotic signaling. The leptin receptor is expressed on T cells and in that cell type it is also associated with decreased T regulatory activity. The IL-12 receptor (IL-12R-beta1/IL-12beta2) is expressed on T cells and is critical for the establishment of the Th1 phenotype of CD4+ and CD8+ T cells. The IL-12 receptor activates JAK2 and TYK2. Specifically, IL-12RB1 associates with TYK2 and IL-12RB2 associates with JAK3. Upon activation JAK2 phosphorylates the tyrosine residues of STAT3 and STAT4 that then translocate to the nucleus and bind to the IFN-gamma promoter, thereby driving Th1 activity and differentiation.

In some embodiments, a TM and/or cytoplasmic domain of JAK/STAT engaging receptors are included in an antigen binding receptor described herein. In one embodiment, an scFv directed to CD19 (e.g. as can be derived from antibody FMC63) is cloned in frame with the TM and cytoplasmic domains of homodimerizing or heterodimerizing receptors having JAK/STAT engaging activities, with suitable linker sequences inserted between these components. The resulting CAR-T cell expresses anti-CD19 scFv and recognition of CD19 on cells (e.g. normal B cells or malignant B cells) induces CAR-T cell activation and proliferation, and supports cells survival, but does not induce cytotoxicity. These qualities of JAK/STAT signaling are seen in hematologic malignancies, including T cell malignancies in which JAK/STAT signaling is dysregulated. The binding of antigen to the scFv will be sufficient to induce receptor dimerization. In related embodiments, scFv will be assessed for their ability to specifically induce receptor dimerization, as monitored by signaling assays and functional assays.

In one embodiment, a TM and/or cytoplasmic domain is derived from the IL-12 receptor chains (IL-12R-beta1/IL-12beta2). In another embodiment, a TM and/or cytoplasmic domain is derived from the IL-6 receptor alpha chain. In another embodiment a TM and/or cytoplasmic domain is derived from the leptin receptor. In another embodiment a TM and/or cytoplasmic domain is derived from the prolactin receptor. In another embodiment a TM and/or cytoplasmic domain is derived from a G-protein coupled receptor that engages the JAK/STAT pathway (e.g. AGTR-1. 5-HT2A, PAR, PAR3, PAR4, Bradykinin-RB2, PAFR, alpha adrenergic receptors, CXCR4, CCR2, CCR5, CCR1). In another embodiment a TM and/or cytoplasmic domain is derived from the IL-12 receptor family (e.g. IL-23R, IL-27R but not IL-35R). In another embodiment a TM and/or cytoplasmic domain is derived from the IL-10 receptor family. In another embodiment a TM and/or cytoplasmic domain is derived the IL-6 receptor family (IL-11R, CNTFR, LIFR, OSMR, GCSFR, IL-31R, CTNFR). In another embodiment a TM and/or cytoplasmic domain is derived from the gamma chain receptor family (e.g. IL-2R, IL-4R, IL-7R, IL-9R, IL-13R, IL-15R, IL-21R and the related receptor TSLPR). In another embodiment a TM and/or cytoplasmic domain is derived are derived from the beta chain receptor family e.g. (IL-3, IL-5R, GM-CSFR). In another embodiment a TM and/or cytoplasmic domain is derived from the homodimeric hormone receptor family (e.g. GHR, TpoR, EpoR). In another embodiment a TM and/or cytoplasmic domain is derived from the RTK family (e.g. Insulin-R, EGFR/ERbB receptors, PDGF receptors, SCF-R/c-Kit, M-CSFR, the FGF receptors 1-4, EphA4, TrkB, Tie2, the VEGF receptors, Mer, HGFR/c-MET). In another embodiment a TM and/or cytoplasmic domain is derived from the Type I/II interferon receptors.

It is understood that for some receptors, it may be desirable to remove one or more signaling components of receptor complex signaling while leaving interaction with JAK/STAT pathways intact. It is understood that methods to make such altered or mutated receptor chains are well-understood and readily available to one skilled in the art.

In some embodiments, a TM and/or cytoplasmic domain of a receptor that engages a JAK/STAT pathway can be used as signaling domains. In one embodiment, a T cell is tranfected with nucleotide sequences encoding an scFv directed to CD19 (e.g., as can be derived from antibody FMC63) cloned in frame with nucleotide sequence encoding a TM and cytoplasmic domain of a receptor that engages a JAK/STAT pathway, optionally with suitable linker sequences inserted between the components. The resulting CAR-T cell expresses anti-CD19 scFv as an antigen binding domain, and recognition of CD19 on cells (e.g., normal B cells or malignant B cells) induces CAR-T cell activation and proliferation, and supports cells survival, but does not induce cytotoxicity. In some embodiments, a consequence of CAR-T cell activation and proliferation is stimulation of specific promoters, e.g., the CD69 promoter, the CD25 promoter, the TNF promoter, the VLA1 promoter, the LFA1 promoter, and many others described herein (see, e.g., Example 9), and can lead to expression of an inducible expression construct described herein. In some embodiments, upon binding of antigen (e.g., CD19) to a first antigen binding receptor (e.g., that includes an anti-CD19 scFv as an antigen binding domain and a transmembrane and/or cytoplasmic domain of a receptor that engages a JAK/STAT pathway) an inducible expression construct encoding a second antigen binding receptor is induced to be expressed. This second, induced, antigen binding receptor can bind to a tumor antigen of interest, and can include a canonical CAR-T signaling domain described herein, e.g. CD3/CD28 or CD3/4-1BB or CD3/CD28/4-1BB. Thus, such an exemplary CAR-T cell has two activities: the first is T cell activation, proliferation and survival, as induced by signaling through the first antigen binding receptor (that includes an anti-CD19 scFv as an antigen binding domain and a transmembrane and/or cytoplasmic domain of a receptor that engages a JAK/STAT pathway); and the second is canonical T cell activation, proliferation, survival and anti-tumor cell cytotoxic activity, where the tumor cell is identified by the target of the induced antigen binding receptor.

In another embodiment, TM and/or cytoplasmic domains of both receptor chains (e.g., classes of alpha/beta, gamma/gamma, alpha/alpha, alpha/lambda, common beta, common gamma, gp130, and specific receptors within the families recited) are used. For example, nucleic acid sequences encoding an anti-CD19 scFv linked to such TM and/or cytoplasmic domains of different receptor chains are expressed in T cells such that a T cell expresses heterodimeric CAR constructs consisting of both receptor chains TM and cytoplasmic domains. Empirical analyses of CAR-mediated signaling and T cell function in response to antigen (e.g. CD19) can be used to identify appropriate receptor TM and cytoplasmic domains representing different receptor chains (e.g. of distinct common beta partners, or distinct gp130 partners) (e.g., domains that induce T cell proliferation and/or survival, but not cytotoxic activity, in response to antigen, e.g. as displayed on antigen-positive cells.

In another embodiment, a cytoplasmic domain of specific receptors or classes of receptor chains are mutagenized to enhance or reduce one or more components of downstream signaling in order to induce T cell activation, proliferation and/or survival, but not cytotoxic activity, in response to antigen, e.g. as displayed on antigen-positive cells. Techniques for mutagenesis and subsequent analyses are well-known and readily apparent to one skilled in the art. In another embodiment, a cytoplasmic domain of specific receptors or classes of receptor chains is mutagenized to enhance or reduce one or more components of downstream signaling in order to further optimize the induction of a specific promoter, e.g. CD69 promoter, CD25 promoter, et alia, and/or as described in Example 9.

In another embodiment, a T cell (i) expresses a first antigen binding receptor (e.g., that includes an scFv as an antigen binding domain and a transmembrane and/or cytoplasmic domain of a receptor that engages JAK/STAT), where the scFv is directed to a first tumor antigen expressed on a tumor type, and (ii) upon binding of the first antigen binding receptor to the first tumor antigen, the T cell is induced to express a second antigen binding receptor that includes an scFv directed to a second tumor antigen expressed on the same tumor type. In some embodiments, the first antigen binding receptor signals T cell activation, proliferation and/or survival, but not cytotoxic activity, and the induced antigen binding receptor (i.e., the second antigen binding receptor) triggers cytoxicity. In some such embodiments, a T cell allows 'antigen-gating', as described herein. This will be useful is cases where engagement of a single antigen provides an insufficient therapeutic window over normal cell (i.e. non-malignant cell) destruction and on-target toxicity. Examples of such 'antigen pairs' include but are not limited to, CD56 and CD138, CD56 and BCMA, CD138 and BCMA (Multiple Myeloma), IL-3R (CD123) and CD33, CD123 and CLEC12A, CD33 and CLEC12A (Acute Myeloid Leukemia), CD56 and c-KIT (e.g. Small Cell Lung Cancer), CEA and PSMA, PSCA and PSMA, CEA and PSCA (Pancreatic Cancer), CA-IX and CD70 (Renal Cell Carcinoma), HER2 and EGFR, Epcam and c-MET, EGFR and IGFR (e.g. for Breast Cancer), MUC16 and Folate Receptor alpha, Mesothelin and Folate Receptor alpha (e.g. Ovarian Cancer, Mesothelioma), and many others. In some examples one might choose to target the tumor microenvironment (TME), e.g. tumor-associated macrophages (TAM) or myeloid-derived suppressor cells (MDSC) or tumor-associated fibroblasts. Examples of relevant targeting antigen pairs include but are not limited to: FAP and CD45, FAP and CSFR1, and CD45 and CSFR1. It is understood that selection of scFv and the epitope of the scFv can be critical for successful recognition of some target antigens distinct from recognition of the CAR-T cell, in cases where the CAR-scFv-receptor for JAK/STAT construct and the antigen target overlap (e.g. ERbB/EGFR receptors). Since use of extracellular residues in the CAR-scFv-receptor for JAK/STAT construct can be limited by design, this is readily accomplished.

In another embodiment, a T cell (i) expresses a first antigen binding receptor (e.g., that includes a bispecific antibody (or portion) as an antigen binding domain and a transmembrane and/or cytoplasmic domain of a receptor that engages JAK/STAT), where the bispecific antibody (or portion) binds a B cell antigen, e.g. CD19, and to a tumor antigen expressed on a tumor of interest, and (ii) upon binding of the first antigen binding receptor to the first tumor antigen, the T cell is induced to express a second antigen binding receptor that includes an scFv directed to a second tumor antigen expressed on the same tumor type. In some embodiments, the first antigen binding receptor utilizes both CD19 recognition (to facilitate expansion and/or persistence) and 'antigen-pair' recognition to facilitate expansion and/or persistence and cytotoxicity. Examples of such 'antigen pairs' include but are not limited to, CD56 and CD138, CD56 and BCMA, CD138 and BCMA (Multiple Myeloma), IL-3R (CD123) and CD33, CD123 and CLEC12A, CD33 and CLEC12A (Acute Myeloid Leukemia), CD56 and c-KIT (e.g. Small Cell Lung Cancer), CEA and PSMA, PSCA and PSMA, CEA and PSCA (Pancreatic Cancer), CA-IX and CD70 (Renal Cell Carcinoma), HER2 and EGFR, Epcam and c-MET, EGFR and IGFR (e.g. for Breast Cancer), MUC16 and Folate Receptor alpha, Mesothelin and Folate Receptor alpha (e.g. Ovarian Cancer, Mesothelioma), and many others. In some examples one might choose to target the tumor microenvironment (TME), e.g. tumor-associated macrophages (TAM) or myeloid-derived suppressor cells (MDSC) or tumor-associated fibroblasts. Examples of relevant targeting antigen pairs include but are not limited to: FAP and CD45, FAP and CSFR1, and CD45 and CSFR1. It is understood that selection of scFv and the epitope of the scFv may be critical for successful recognition of some target antigens distinct from recognition of the CAR-T cell, in cases where the CAR-scFv-receptor for JAK/STAT construct and the antigen target overlap (e.g. ERbB/EGFR receptors). Since use of extracellular residues in the CAR-scFv-receptor for JAK/STAT construct can be limited by design, this is readily accomplished.

Inducible Expression Constructs

In some embodiments, an "inducible expression construct" as used herein may be or comprises a nucleic acid sequence that includes at least a promoter operably linked to a nucleotide sequence of interest, e.g., a gene described herein. An inducible expression construct can comprise regulatory sequences, such as transcription and translation initiation and termination codons. In some embodiments, such regulatory sequences are specific to the type of cell into which an inducible expression construct is to be introduced, as appropriate. In some embodiments, such regulatory sequences are specific to a signaling pathway induced by a signaling domain described herein.

An inducible expression construct can comprise a native or non-native promoter operably linked to the nucleic acid encoding the gene of interest. Preferably, the promoter is functional in immune cells. Operably linking of a nucleotide sequence with a promoter is within the skill of the artisan. The promoter can be a non-viral promoter or a viral promoter, e.g., a cytomegalovirus (CMV) promoter, an SV40 promoter, an RSV promoter, or a promoter found in the long-terminal repeat of the murine stem cell virus. In some embodiments, a promoter includes an NFAT, NF-κB, AP-1 or other recognition sequence, as examples.

In some embodiments, a promoter included in an inducible expression construct described herein is an IL-2 promoter, a cell surface protein promoter (e.g., CD69 promoter), a cytokine promoter (e.g., TNF promoter), a cellular activation promoter (e.g., CTLA4, OX40, CD40L), or a cell surface adhesion protein promoter (e.g., VLA-1 promoter). The selection of a promoter, e.g., strong, weak, inducible, tissue-specific, developmental-specific, having specific kinetics of activation (e.g., early and/or late activation), and/or having specific kinetics of expression of an induced gene (e.g., short or long expression) is within the ordinary skill of the artisan. In some embodiments, a promoter mediates rapid, sustained expression, measured in days (e.g., CD69). In some embodiments, a promoter mediates delayed expression, late-inducible (e.g., VLA1). In some embodiments, a promoter mediates rapid, transient expression (e.g., TNF, immediate early response genes and many others).

Upon antigen binding by an antigen binding receptor, a signal can be transduced from a signaling domain of an antigen binding receptor described herein to an inducible expression construct, e.g., using a known pathway (see, e.g., Chow et al., Mol. Cell. Biol. 19:2300-2307 (1999); Castellanos et al., J. Immunol. 159:5463-73 (1997); Kramer et al., JBC 270:6577-6583 (1995); Gibson et al., J. Immunol. 179:3831-40 (2007)); Tsytsykova et al., J. Biol. Chem. 271:3763-70 (1996); Goldstein et al., J. Immunol. 178:201-10 (2007)). Thus, upon binding of an antigen, an antigen binding receptor activates a signal transduction pathway that leads to induction of expression (e.g., by binding of a transcription factor to a promoter described herein).

Genes for Expression Constructs

Any gene can be included in an expression construct described herein (e.g., a constitutive expression construct or inducible expression construct), and the present disclosure is not limited to any particular gene. Exemplary, non-limiting types of genes that can be included in an expression construct include, e.g., genes encoding polypeptides (e.g., polypeptide antigens and/or therapeutic peptides), antibodies (e.g., antigen-binding fragments of antibodies and/or fusion proteins comprising an antibody or antigen-binding fragment(s)), cytokines, chemokines, cytokine receptors, chemokine receptors, toxins, agents targeting tumor microenvironment, and agents supporting immune cell growth/proliferation. In some examples a gene sequence included in an expression construct is transcribed, and then translated. In other cases, transcribed therapeutics have utility as genes, as is known for RNAi, miRNA, shRNA and other classes of regulatory RNAs, without limitation.

1. Expressed Polypeptides

In some embodiments, a cellular therapeutic described herein can include an expression construct (e.g., a constitutive expression construct or inducible expression construct) that encodes a polypeptide antigen (or a fragment thereof, e.g., a fragment that includes an epitope). In some embodiments, an expression construct includes a nucleotide sequence encoding a tumor antigen. Tumor antigens are known in the art and include, for example, a glioma-associated antigen, carcinoembryonic antigen (CEA), β-human chorionic gonadotropin, alphafetoprotein (AFP), lectin-reactive AFP, thyroglobulin, RAGE-1, MN-CA IX, human telomerase reverse transcriptase, RU1, RU2 (AS), intestinal carboxyl esterase, mut hsp70-2, M-CSF, prostase, prostate-specific antigen (PSA), PAP, NY-ESO-1, LAGE-1α, p53, prostein, PSMA, Her2/neu, survivin and telomerase, prostate-carcinoma tumor antigen-1 (PCTA-1), MAGE, ELF2M, neutrophil elastase, ephrinB2, CD22, insulin growth factor (IGF)-I, IGF-II, IGF-I receptor, and mesothelin.

In some embodiments, a tumor antigen is or comprises one or more antigenic cancer epitopes associated with a malignant tumor. Malignant tumor antigens that include such epitopes include, e.g., tissue-specific antigens such as MART-1, tyrosinase and GP 100 in melanoma and prostatic acid phosphatase (PAP) and prostate-specific antigen (PSA) in prostate cancer. Other tumor antigens belong to the group of transformation-related molecules such as the oncogene HER-2/Neu/ErbB-2. Yet another group of tumor antigens are onco-fetal antigens such as carcinoembryonic antigen (CEA). In B-cell lymphoma the tumor-specific idiotype immunoglobulin constitutes a tumor-specific immunoglobulin antigen that is unique to the individual tumor. B-cell differentiation antigens such as CD19, CD20 and CD37 are other tumor antigens in B-cell lymphoma. Some of these antigens (e.g., CEA, HER-2, CD19, CD20, idiotype) have been used as targets for passive immunotherapy with monoclonal antibodies with limited success.

A tumor antigen described herein can be a tumor-specific antigen (TSA) or a tumor-associated antigen (TAA). A TSA is (or is believed to be) unique to tumor cells and does not occur on other cells in the body (e.g., does not occur to a significant extent on other cells). A TAA is not unique to a tumor cell and instead is also expressed on a normal cell (e.g., expressed under conditions that fail to induce a state of immunologic tolerance to the antigen). For example, TAAs can be antigens that are expressed on normal cells during fetal development when the immune system is immature and unable to respond, or they can be antigens that are normally present at extremely low levels on normal cells but that are expressed at higher levels on tumor cells.

Non-limiting examples of TSA or TAA antigens include differentiation antigens such as MART-1/MelanA (MART-I), gp100 (Pmel 17), tyrosinase, TRP-1, TRP-2 and tumor-specific multilineage antigens such as MAGE-1, MAGE-3, BAGE, GAGE-1, GAGE-2, p15; overexpressed embryonic antigens such as CEA; overexpressed oncogenes and mutated tumor-suppressor genes such as p53, Ras, HER-2/neu; unique tumor antigens resulting from chromosomal translocations such as BCR-ABL, E2A-PRL, H4-RET, IGH-IGK, MYL-RAR; and viral antigens, such as the Epstein Barr virus antigens EBVA and the human papillomavirus (HPV) antigens E6 and E7. Other tumor antigens include TSP-180, MAGE-4, MAGE-5, MAGE-6, RAGE, NY-ESO, erbB, p185erbB2, p180erbB-3, c-met, nm-23H1, PSA, TAG-72, CA 19-9, CA 72-4, CAM 17.1, NuMa, K-ras, beta-Catenin, CDK4, Mum-1, p 15, p 16, 43-9F, 5T4, 791Tgp72, alpha-fetoprotein, beta-HCG, BCA225, BTAA, CA 125, CA 15-3\CA 27.29\BCAA, CA 195, CA 242, CA-50, CAM43, CD68\P1, CO-029, FGF-5, G250, Ga733\EpCAM, HTgp-175, M344, MA-50, MG7-Ag, MOV18, NB/70K, NY-CO-1, RCAS1, SDCCAG16, TA-90\Mac-2 binding protein\cyclophilin C-associated protein, TAAL6, TAG72, TLP, MUC16, IL13Rα2, FRα, VEGFR2, Lewis Y, FAP, EphA2, CEACAM5, EGFR, CA6, CA9, GPNMB, EGP1, FOLR1, endothelial receptor, STEAP1, SLC44A4, Nectin-4, AGS-16, guanalyl cyclase C, MUC-1, CFC1B, integrin alpha 3 chain (of a3b1, a laminin receptor chain), and TPS.

In some embodiments, a tumor antigen is CD19, CD20, CD22, CD30, CD72, CD180, CD171 (L1CAM), CD123, CD133, CD138, CD37, CD70, CD79a, CD79b, CD56, CD74, CD166, CD71, CLL-1/CLECK12A, ROR1, Glypican 3 (GPC3), Mesothelin, CD33/IL3Ra, c-Met, PSCA, PSMA, Glycolipid F77, EGFRvIII, GD-2, MY-ESO-1, or MAGE A3. Additional tumor antigens can be identified, e.g., by sequencing tumor genomes and exomes, and/or by high-sensitivity mass spectrometry analysis of the tumor proteome, any of which can be used in methods described herein.

In some embodiments, a tumor antigen is a generic or "housekeeping" membrane protein, e.g., found on every cell. In some embodiments, a tumor antigen is a tumor stem cell marker. In some embodiments, a tumor antigen is a neoantigen (i.e., an antigen that arises in a tumor itself, e.g., because of aberrant proliferation).

In some embodiments, an expressed polypeptide is included as part of a fusion protein, e.g., a fusion protein that includes the polypeptide antigen and an antibody or antibody fragment described herein. In some embodiments, a fusion protein is or includes a polypeptide antigen fused to the amino (N) terminus of another protein, for example, a polypeptide antigen fused to the amino (N) terminus of an antigen binding protein (e.g., antibody or antibody fragment described herein, or a scaffold protein described herein (e.g., Kunitz-like domain, ankyrin repeat domain, lipoclains, Type III fibronectin domain, CD19 variant protein, or B cell specific marker variant described herein)). In some embodiments, a fusion protein is or includes a polypeptide antigen fused to the amino terminus of a light chain of an antibody, or a fragment thereof. In some embodiments, a fusion protein is or includes a polypeptide antigen fused to the amino terminus of a heavy chain of an antibody, or portion thereof.

In some embodiments, a fusion protein is or includes a polypeptide antigen fused to the carboxyl (C) terminus of another protein, for example, a polypeptide antigen fused to the carboxyl (C) terminus of an antigen binding protein (e.g., antibody or antibody fragment described herein, or a scaffold protein described herein (e.g., Type III fibronectin domain, CD19 variant protein, or B cell specific marker variant described herein)). In some embodiments, a fusion protein is or includes a polypeptide antigen fused to the carboxyl terminus of a light chain of an antibody, or a fragment thereof. In some embodiments, a fusion protein is or includes a polypeptide antigen fused to the carboxyl terminus of a heavy chain of an antibody, or portion thereof.

In some embodiments, an expressed polypeptide antigen (or a fragment thereof) is expressed on the surface of the cellular therapeutic and/or is secreted by the cellular therapeutic and/or binds to the surface of a tumor cell. While any polypeptide can be expressed from an expression construct described herein, in particular embodiments, a polypeptide is selected that is a target of (e.g., binds to) an antigen-binding protein described herein (e.g., an antibody (e.g., a bispecific antibody or multi-specific antibody or fragment thereof), an antibody fusion protein or an antibody-drug conjugate). In some embodiments, the antibody or antibody fusion protein can be, e.g., a known therapeutic antibody (e.g., one that exhibits ADCC or CDC), a therapeutic fusion protein, or a therapeutic antibody-drug conjugate.

In some embodiments, a nucleic acid encoding a polypeptide antigen that binds to one or more known antibodies or antibody-drug conjugates can be included in an expression construct described herein. Various review articles have been published that describe useful anti-tumor antibodies (see, for example, Adler et al., Hematol. Oncol. Clin. North Am. 26:447-81 (2012); Li et al., Drug Discov. Ther. 7:178-84 (2013); Scott et al., Cancer Immun. 12:14 (2012); and Sliwkowski et al., Science 341:1192-1198 (2013)). Table 1 presents a non-comprehensive list of certain human polypeptide antigens targeted by known, available antibody agents, and notes certain cancer indications for which the antibody agents have been proposed to be useful:

TABLE 1

| Human Antigen | Antibody (commercial or scientific name) | Cancer indication |
| --- | --- | --- |
| CD2 | Siplizumab | Non-Hodgkin's Lymphoma |
| CD3 | UCHT1 | Peripheral or Cutaneous T-cell |
| CD4 | HuMax-CD4 | Lymphoma |
| CD19 | SAR3419, MEDI-551 | Diffuse Large B-cell Lymphoma |
| CD19 and CD3 or CD22 | Bispecific antibodies such as Blinatumomab, DT2219ARL | Non-Hodgkin's Lymphoma |
| CD20 | Rituximab, Veltuzumab, Tositumomab, Ofatumumab, Ibritumomab, Obinutuzumab, | B cell malignancies (Non-Hodgkin's lymphoma, Chronic lymphocytic leukemia) |
| CD22 (SIGLEC2) | Inotuzumab, tetraxetan, CAT-8015, DCDT2980S, Bectumomab | Chemotherapy-resistant hairy cell leukemia, Hodgkin's lymphoma |
| CD30 | Brentuximab vedotin | |
| CD33 | Gemtuzumab ozogamicin (Mylotarg) | Acute myeloid leukemia |
| CD37 | TRU-016 | Chronic lymphocytic leukemia |
| CD38 | Daratumumab | Multiple myeloma, hematological tumors |
| CD40 | Lucatumumab | Non-Hodgkin's lymphoma |
| CD52 | Alemtuzumab (Campath) | Chronic lymphocytic leukemia |
| CD56 (NCAM1) | Lorvotuzumab | Small Cell Lung Cancer |
| CD66e (CEA) | Labetuzumab | Breast, colon and lung tumors |
| CD70 | SGN-75 | Non-Hodgkin's lymphoma |
| CD74 | Milatuzumab | Non-Hodgkin's lymphoma |
| CD138 (SYND1) | BT062 | Multiple Myeloma |
| CD152 (CTLA-4) | Ipilimumab | Metastatic melanoma |
| CD221 (IGF1R) | AVE1642, IMC-A12, MK-0646, R150, CP 751871 | Glioma, lung, breast, head and neck, prostate and thyroid cancer |
| CD254 (RANKL) | Denosumab | Breast and prostate carcinoma |
| CD261 (TRAILR1) | Mapatumumab | Colon, lung and pancreas tumors and haematological malignancies |
| CD262 (TRAILR2) | HGS-ETR2, CS-1008 | |
| CD326 (Epcam) | Edrecolomab, 17-1A, IGN101, Catumaxomab, Adecatumumab | Colon and rectal cancer, malignant ascites, epithelial tumors (breast, colon, lung) |

TABLE 1-continued

| Human Antigen | Antibody (commercial or scientific name) | Cancer indication |
|---|---|---|
| CD309 (VEGFR2) | IM-2C6, CDP791 | Epithelium-derived solid tumors |
| CD319 (SLAMF7) | HuLuc63 | Multiple myeloma |
| CD340 (HER2) | Trastuzumab, Pertuzumab, Ado-trastuzumab emtansine | Breast cancer |
| CAIX (CA9) | cG250 | Renal cell carcinoma |
| EGFR (c-erbB) | Cetuximab, Panitumumab, nimotuzumab and 806 | Solid tumors including glioma, lung, breast, colon, and head and neck tumors |
| EPHA3 (HEK) | KB004, IIIA4 | Lung, kidney and colon tumors, melanoma, glioma and haematological malignancies |
| Episialin | Epitumomab | Epithelial ovarian tumors |
| FAP | Sibrotuzumab and F19 | Colon, breast, lung, pancreas, and head and neck tumors |
| HLA-DR beta | Apolizumab | Chronic lymphocytic leukemia, non-Hodkin's lymphoma |
| FOLR-1 | Farletuzumab | Ovarian tumors |
| 5T4 | Anatumomab | Non-small cell lung cancer |
| GD3/GD2 | 3F8, ch14.18, KW-2871 | Neuroectodermal and epithelial tumors |
| gpA33 | huA33 | Colorectal carcinoma |
| GPNMB | Glembatumumab | Breast cancer |
| HER3 (ERBB3) | MM-121 | Breast, colon, lung, ovarian, and prostate tumors |
| Integrin αVβ3 | Etaracizumab | Tumor vasculature |
| Integrin α5β1 | Volociximab | Tumor vasculature |
| Lewis-Y antigen | hu3S193, IgN311 | Breast, colon, lung and prostate tumors |
| MET (HGFR) | AMG 102, METMAB, SCH900105 | Breast, ovary and lung tumors |
| Mucin-1/CanAg | Pemtumomab, oregovomab, Cantuzumab | Breast, colon, lung and ovarian tumors |
| PSMA | ADC, J591 | Prostate Cancer |
| Phosphatidylserine | Bavituximab | Solid tumors |
| TAG-72 | Minretumomab | Breast, colon and lung tumors |
| Tenascin | 81C6 | Glioma, breast and prostate tumours |
| VEGF | Bevacizumab | Tumour vasculature |

In some embodiments, a cellular therapeutic that includes an expression construct (e.g., a constitutive expression construct or inducible expression construct) encoding one or more such polypeptide antigens is administered to a subject in combination with one or more of these (or other) known antibodies.

Antibody-drug conjugates are known and include, e.g., brentuximab vedotin (ADCETRIS®, Seattle Genetics); ado-trastuzumab emtansine (KADCYLA®, Roche); Gemtuzumab ozogamicin (Wyeth); CMC-544; SAR3419; CDX-011; PSMA-ADC; BT-062; and IMGN901 (see, e.g., Sassoon et al., Methods Mol. Biol. 1045:1-27 (2013); Bouchard et al., Bioorganic Med. Chem. Lett. 24: 5357-5363 (2014)). In some embodiments, a nucleic acid encoding a polypeptide antigen that binds to one or more of such known antibody-drug conjugates can be included in an expression construct described herein. In some such embodiments, a cellular therapeutic that includes an expression construct encoding one or more such polypeptide antigens is administered to a subject in combination with one or more of these (or other) known antibody-drug conjugates.

In some embodiments, an expressed polypeptide is included as part of a fusion protein. For example, an expression construct can encode a fusion protein comprising an expressed polypeptide described herein (e.g., a polypeptide target for an antibody, an antibody fusion protein, and/or antibody drug conjugate) and a second polypeptide (e.g., a scaffold protein described herein (e.g., Type III fibronectin domain, CD19 variant protein, or B cell specific marker variant described herein), an antibody or fragment thereof, e.g., Fab fragment, Fab' fragment, F(ab')$_2$ fragment, scFv fragment, Fv fragment, dsFv diabody, dAb fragment, Fd' fragment, Fd fragment, CDR region, a cameloid antibody, a masked antibody (e.g., Probody®), a single chain or Tandem diabody (TandAb®), a VHH, an Anticalin®, a single-domain antibody (e.g., Nanobody®), an ankyrin repeat protein or DARPIN®, an Avimer®, an Adnectin®, an Affilin®, an Affibody®, a Fynomer®, or a Centyrin®) that targets (e.g., binds to) a tumor antigen such as a tumor antigen described herein.

Figure 9:
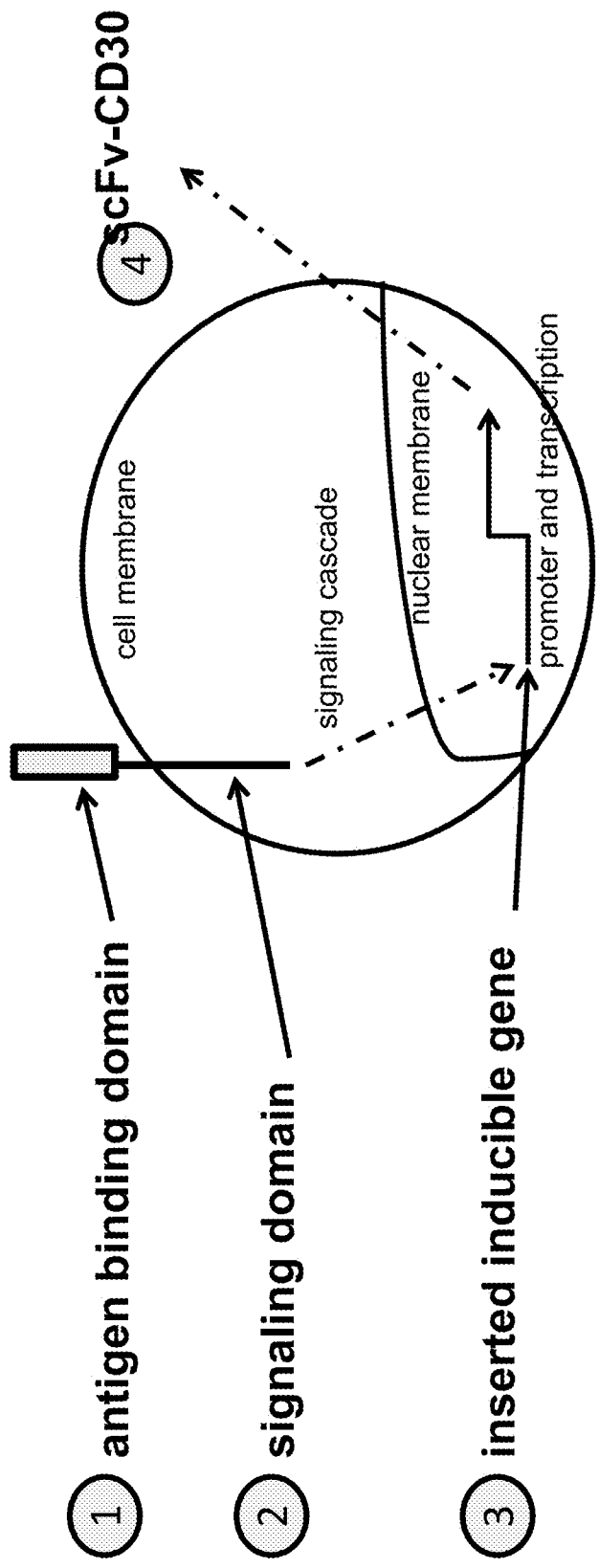
FIG. 9 is a schematic depicting an exemplary cellular therapeutic encoding an inducible scFv-CD30 fusion protein.

One exemplary cellular therapeutic is depicted in FIG. 9. As shown in FIG. 9, an exemplary cellular therapeutic includes an antigen binding receptor, which includes an antigen binding domain (e.g., an antigen binding domain described herein) and a signaling domain (e.g., a signaling domain described herein). The cellular therapeutic also includes an inducible expression construct (e.g., an inducible expression construct described herein), which encodes an scFv-CD30 fusion protein. Upon binding of the antigen binding domain to an antigen on a tumor cell (e.g., after administration to a subject), the signaling domain induces expression of the scFv-CD30 fusion protein. The scFv portion of the fusion protein binds to a second antigen on the tumor cell, localizing CD30 (i.e., the scFv fusion partner) to the tumor cell. In this exemplary embodiment, ADCETRIS® (brentuximab vedotin; Seattle Genetics) is subsequently administered to target CD30. Upon binding to CD30 of the scFv-CD30 fusion protein (which is bound to the tumor cell), ADCETRIS® leads to killing of proliferating tumor cells.

In another embodiment, a cellular therapeutic includes a chimeric antigen receptor (CAR) on its surface, which includes an antigen binding domain (e.g., an antigen binding domain described herein) and a signaling domain (e.g., a signaling domain described herein). The cellular therapeutic also includes an inducible expression construct (e.g., an inducible expression construct described herein), which encodes CD30. Upon binding of the antigen binding domain to an antigen on a tumor cell (e.g., after administration to a subject), the signaling domain induces expression of CD30 on its surface. In this exemplary embodiment, ADCETRIS is used (e.g., administered to the subject) to target CD30 on the cellular therapeutic and, upon binding to CD30 on a surface of the cellular therapeutic, results in local killing of proliferating tumor cells.

These are a few exemplary cellular therapeutics, and do not limit the present disclosure. For example, any of the listed antigens in Table 1 can be encoded by an expression construct, either alone or as part of a fusion protein (e.g., a fusion protein that includes a polypeptide that targets a tumor antigen). Any such cellular therapeutic can be used alone or in combination with a corresponding antibody or antibody drug conjugate listed in Table 1.

In some embodiments, an expression construct (e.g., a constitutive expression construct or inducible expression construct) can encode a fusion protein comprising a polypeptide that is a target for (e.g., binds to) one or more known radioactive antibodies (e.g., a radioactive antibody used in radio-immunotherapy (RIT)) and a second polypeptide (e.g., a scaffold protein described herein (e.g., Type III fibronectin domain, CD19 variant protein, or B cell specific marker variant described herein), an antibody or fragment thereof, e.g., Fab fragment, Fab' fragment, F(ab')$_2$ fragment, scFv fragment, Fv fragment, dsFv diabody, dAb fragment, Fd' fragment, Fd fragment, or CDR region) that targets (e.g., binds to) a tumor antigen such as a tumor antigen described herein. Radioactive antibodies are known (e.g., BEXXAR® (Corixa), ZEVALIN® (Spectrum Pharmaceuticals), Actimab-A (anti-CD33 antibody lintuzumab linked to actinium-225; Actinium Pharmaceuticals), and monoclonal antibodies with beta emitters, e.g., Lu177 (see, e.g., Nordic Nano). In addition, any antibody described herein can be linked, directly or indirectly, to a radioisotope including, e.g., beta-emitters, Auger-emitters, conversion electron-emitters, alpha-emitters, and low photon energy-emitters. Exemplary radioisotopes may include long-range beta-emitters, such as $^{90}$Y, $^{32}$P, $^{186}$Re/$^{188}$Re; $^{166}$Ho, $^{76}$As/$^{77}$As, $^{89}$Sr, $^{153}$Sm; medium range beta-emitters, such as $^{131}$I, $^{177}$Lu, $^{67}$Cu, $^{161}$Tb, $^{105}$Rh; low-energy beta-emitters, such as $^{45}$Ca or $^{35}$S; conversion or Auger-emitters, such as $^{51}$Cr, $^{67}$Ga, $^{99m}$Tc, $^{111}$In, $^{114m}$In, $^{123}$I, $^{125}$I, $^{201}$Tl; and alpha-emitters, such as $^{212}$Bi, $^{213}$Bi, $^{223}$Ac, $^{225}$Ac, $^{212}$Pb, $^{255}$Fm, $^{223}$Ra, $^{149}$Tb and $^{221}$At. Suitable linkers are known in the art and include, for example, prosthetic groups, non-phenolic linkers (derivatives of N-succimidyl-benzoates; dodecaborate), chelating moieties of both macrocyclics and acyclic chelators, such as derivatives of 1,4,7,10-tetraazacyclododecane-1,4,7,10,tetraacetic acid (DOTA), derivatives of diethylenetriaminepentaacetic avid (DTPA), derivatives of S-2-(4-Isothiocyanato-benzyl)-1,4,7-triazacyclononane-1,4,7-triacetic acid (NOTA) and derivatives of 1,4,8,11-tetraazacyclodocedan-1,4,8,11-tetraacetic acid (TETA) and other chelating moieties. Radiolabeling of such antibodies is known in the art (see, e.g., Barbet et al., Methods Mol. Biol. 907:681-97 (2014); Steiner et al., Clin. Cancer Res. 17:6406 (2011); Goldenberg, J. Nucl. Med. 43:693-713 (2002)).

In some embodiments, an expression construct (e.g., a constitutive expression construct or inducible expression construct) includes a gene encoding a polypeptide antigen that is a target for one or more additional cellular therapeutics, e.g., CAR-T cells. CAR-T cells are known in the art and include CAR-T cells targeting, e.g., CD19, CD20, CD22, CD30, CD33, CD171, CD133, EphA2, estrogen receptor, progesterone receptor, EGF receptor (EGFR), EGFR mutants (e.g., EGFRvIII), CEA, GPC3, HER-2, GD2, alpha-fetoprotein (AFP), CA19-9, prostate specific antigen (PSA), and BCMA (see, e.g., Juno Therapeutics; Bellicum; Kite Pharma; Cellectis; Hillerdal et al., BioDrugs 29:75-89 (2015); Magee e tal., Discov. Med. 18:265-71 (2014); Kakarla et al., Cancer J. 20:151-155 (2014)). CAR-T cells generally kill only cells expressing a particular antigen recognized by a particular type of CAR-T cell. One known problem with use of CAR-T cells involves tumor heterogeneity. Solid tumors, e.g., are characterized by heterogeneous antigen distribution. In some embodiments, methods and compositions of the disclosure increase the number and/or types of tumors that can be recognized by a particular CAR-T cell. For example, in some embodiments, an expression construct described herein expresses a target antigen for one or more known CAR-T cells. In some such embodiments, after expression of a target antigen, such target antigen is secreted from a cellular therapeutic and can bind on or near a tumor cell. Upon subsequent treatment with a CAR-T cell that targets the target antigen, such CAR-T cell binds to the expressed target antigen on or near the tumor cell. Some such methods thus allow the use of a specific CAR-T cell to target a tumor cell that it would not otherwise target (i.e., a tumor cell that does not express a relevant target antigen).

In some embodiments, a cellular therapeutic described herein can include an expression construct (e.g., a constitutive expression construct or inducible expression construct) that encodes a polypeptide target (e.g., a CAR target) for one or more additional cellular therapeutics (e.g., CAR-T). Without wishing to be bound by theory, it is believed that such an expressed polypeptide target (e.g., CAR target) can provide a targeting and/or killing advantage and/or can provide a proliferative and/or survival advantage to TIL and/or TCR T cells (e.g., resulting in differentiation of a memory T cell subset and/or a long-lived NK cell subset). A polypeptide antigen to be expressed by an expression construct described herein is not limited to any particular polypeptide or portion thereof, provided that an additional cellular therapeutic (e.g., CAR-T cell) is available and/or can be engineered to recognize and bind to such polypeptide target. In some embodiments, a polypeptide target is a polypeptide that is not a tumor-associated antigen. In some embodiments, the target is a tumor antigen described herein, e.g., CD19, CD20, CD22, ROR1, Glypican 3 (GPC3), mesothelin, CD33/IL3Ra, c-Met, PSMA, Glycolipid F77, EGFRvIII, GD-2, NY-ESO-1, or MAGE A3. In some embodiments, such a polypeptide target can be encoded by an expression construct, either alone or as part of a fusion protein (e.g., a fusion protein that includes a polypeptide that targets a tumor antigen as described herein). Any such cellular therapeutic can be used alone or in combination with a corresponding additional cellular therapeutic (e.g., CAR-T cell).

In some embodiments, an expression construct encodes a therapeutic peptide. For example, a therapeutic peptide can block interaction of TGFβ with a TGFβ receptor, and/or block interaction of PD-1 with PD-L1. Additional therapeutic peptides are known in the art.

In some embodiments, an expression construct encodes a TLR agonist, an NK ligand, and/or an NKT ligand.

In some embodiments, an expressed polypeptide includes a signal sequence, e.g., to lead to secretion of the polypeptide from a cellular therapeutic. Signal sequences and their uses are known in the art.

In some embodiments, a constitutive expression construct encodes one or more polypeptides described herein. In some embodiments, an induced expression construct encodes one or more polypeptides described herein. In some embodiments, a polypeptide described herein can additionally or alternatively be produced and/or purified using known methods. In some embodiments, such produced and/or purified polypeptide can be used, as described herein, as a protein therapeutic.

2. Expressed Antibodies

In some embodiments, a cellular therapeutic includes an expression construct (e.g., a constitutive expression construct or inducible expression construct) that encodes an antibody (or fragment thereof), and/or a fusion protein comprising an antibody or fragment thereof. Antibodies include, e.g., intact IgG, IgE and IgM, bi- or multi-specific antibodies (e.g., Zybodies®, etc), single chain Fvs, polypeptide-Fc fusions, Fabs, cameloid antibodies, masked antibodies (e.g., Probodies®), Small Modular ImmunoPharmaceuticals ("SMIPs™"), single chain or Tandem diabodies (TandAb®), VHHs, Anticalins®, Nanobodies®, minibodies, BiTE®s, ankyrin repeat proteins or DARPINs®, Avimers®, a DART, a TCR-like antibody, Adnectins®, Affilins®, Trans-bodies®, Affibodies®, a TrimerX®, MicroProteins, Fynomers®, Centyrins®, and a KALBITOR®. Exemplary antibodies are listed in Table 1. In some embodiments, an antibody targets PD-1, TIM-3, LAG-3, DO, A2AR, TGFbeta, CD47, or another protein involved in an immunosuppressive pathway. For example, an inducible expression construct can encode an antibody fragment (e.g., anti-PD1 scFv; anti-PD-L1 scFv; anti-CD39 scFv; or anti-CD73 scFv).

In some embodiments, a cellular therapeutic includes an expression construct that encodes a fusion protein comprising an antibody (or fragment thereof) and an additional polypeptide described herein. In some embodiments, an expression construct described herein encodes a fusion protein comprising an antibody (or antigen-binding fragment thereof) and a target for one or more additional cellular therapeutics (e.g., a CAR-T target). An antibody (or fragment) can be selected to bind, e.g., to a tumor antigen (e.g., a TAA or TSA described herein), and its fusion partner can include a target for one or more additional cellular therapeutics. Such antibodies (or antigen-binding fragments) include, e.g., a monoclonal antibody (mAb), Fv, scFv, a VHH domain, a diabody, a nanobody, etc. In one example, an expression construct encodes a fusion protein of a mAb (e.g., an anti-tumor associated antigen mAb or antigen-binding fragment) and CD19 or a fragment thereof (e.g., a CD19 Ig domain).

In some embodiments, an antibody (or fragment) binds to an antigen expressed on several types of cells. In some embodiments, an antibody (or fragment) binds to a tumor-selective antigen. In some embodiments, an antibody (or fragment) binds to a tumor-selective, but not specific, antigen. In some embodiments, an antibody (or fragment) binds to a tumor antigen associated with a hematologic malignancy. In some embodiments, an antibody (or fragment) binds to a tumor antigen associated with a solid tumor. In some embodiments, an antibody (or fragment) binds to one or more of CD3, CD16, CD19, CD20, CD22, CD72, CD180, ROR1, CCL-1, Glypican 3 (GPC3), mesothelin, CD33/IL3Ra, c-Met, PSMA, Glycolipid F77, EGFRvIII, GD-2, NY-ESO-1, and MAGE A3.

In some embodiments, an antibody (or fragment) binds to a B cell specific marker described herein including, e.g., CD19, CD20, CD21, CD22, CD24, CD79a, CD79b, ROR1, or BCMA. In some embodiments, an antibody (or fragment) binds to a fragment or portion of a B cell specific marker. For example, in some embodiments, an antibody (or fragment) binds to a large extracellular loop (e.g., at least a portion of amino acids 163-187) of CD20 (see Du et al. JBC Vol. 282, NO. 20, 2007, pp. 15073-15080).

Some such embodiments can be used, e.g., in combination with a cellular therapeutic, e.g., a CAR-T cell that targets a B cell specific marker (e.g., to treat a B cell tumor). Upon administration of a cellular therapeutic (e.g., a CAR-T cell) to a subject, expansion of the CAR-T cell can mediate efficacy, which in certain instances can require continuous antigen stimulation. For a CAR-T cell that targets a B cell specific marker, normal B cells in a subject can provide the antigen target for the CAR-T cell, providing CAR-T cell stimulation and expansion. However, B cells (expressing the B cell specific marker) are destroyed by the CAR-T cell along with B cell tumors expressing the same B cell specific marker. Thus, in some embodiments, an expression construct encodes a fusion protein comprising an antibody (or antigen-binding fragment thereof) and a B cell specific marker. An antibody (or fragment) can be selected to bind, e.g., to a tumor antigen (e.g., a TAA or TSA described herein), and the B cell specific marker can be a target for an additional cellular therapeutic, e.g., CAR-T cell. In some such embodiments, a fusion protein binds to a tumor antigen, and a B cell specific marker (bound to the tumor antigen) provides cell stimulation and expansion for an additional cellular therapeutic, e.g., CAR-T cell, administered to a subject.

One exemplary embodiment of a cellular therapeutic is depicted in FIG. 2. As shown in FIG. 2, a cellular therapeutic includes an antigen binding receptor on its surface, which includes an antigen binding domain (e.g., an antigen binding domain described herein) and a signaling domain (e.g., a signaling domain described herein). The cellular therapeutic also includes an inducible expression construct (e.g., an inducible expression construct described herein), which encodes an scFv-CD19 IgC domain fusion protein. Upon binding of the antigen binding domain to a first antigen on a tumor cell, the signaling domain induces expression of the scFv-CD19 IgC domain fusion protein. The scFv portion of the fusion protein binds to a second antigen on the tumor cell (e.g., a tumor-associated antigen, TAA), localizing CD19 (i.e., the scFv fusion partner) to the tumor cell. The tumor cell is thus "decorated" with CD19. An additional cellular therapeutic (e.g., a CAR-T that includes an antigen binding domain that binds to CD19) binds to CD19 of the scFv-CD19 fusion protein (which is bound to the tumor cell), and subsequently kills the CD19-"decorated" tumor cell. As depicted in FIG. 2, the induced scFv-CD19 fusion protein can also target a second tumor cell, which does not express the first antigen, allowing the CAR-T cell to bind to and kill the second tumor cell. FIG. 2 illustrates an exemplary method to overcome tumor heterogeneity with respect to expressed antigens.

Figure 3:
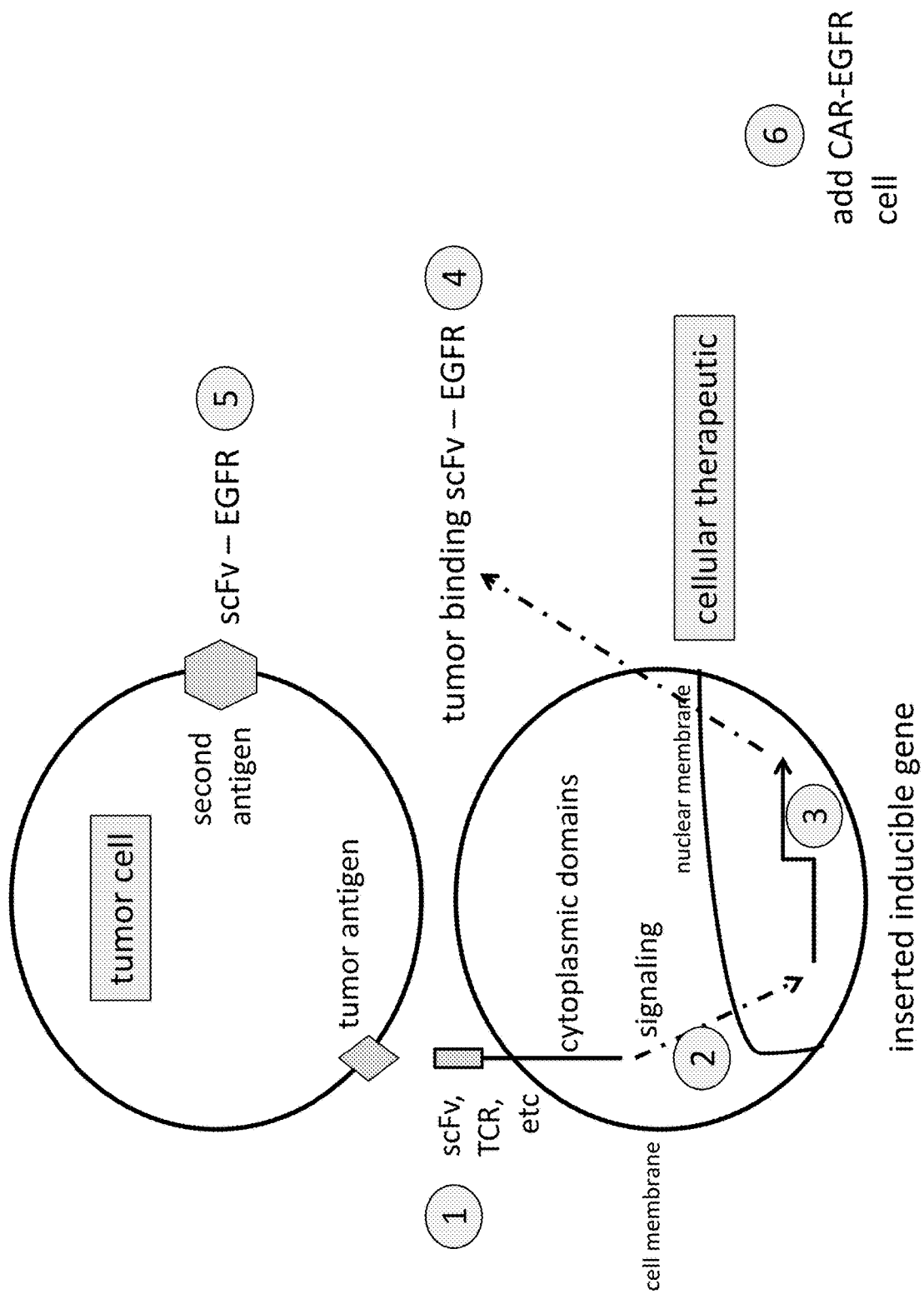
FIG. 3 is a schematic depicting an exemplary cellular therapeutic encoding an inducible scFv-EGFR fusion protein.

Another exemplary embodiment of a cellular therapeutic is depicted in FIG. 3. As shown in FIG. 3, a cellular therapeutic includes an antigen binding receptor on its surface, which includes an antigen binding domain (e.g., an antigen binding domain described herein) and a signaling domain (e.g., a signaling domain described herein). The cellular therapeutic additionally includes an inducible expression construct (e.g., an inducible expression construct described herein), which encodes an scFv-EGFR fusion protein. Upon binding of the antigen binding domain to a first antigen on a tumor cell, the signaling domain induces expression of the scFv-EGFR fusion protein. The scFv portion of the fusion protein binds to a second antigen on the tumor cell, localizing EGFR (i.e., the scFv fusion partner) to the tumor cell. The tumor cell is thus "decorated" with EGFR. An additional cellular therapeutic (e.g., a CAR-T that includes an antigen binding domain that binds to EGFR) can be used to bind to EGFR of the scFv-EGFR fusion protein (which is bound to the tumor cell), and subsequently kill the EGFR-"decorated" tumor cell.

Figure 4:
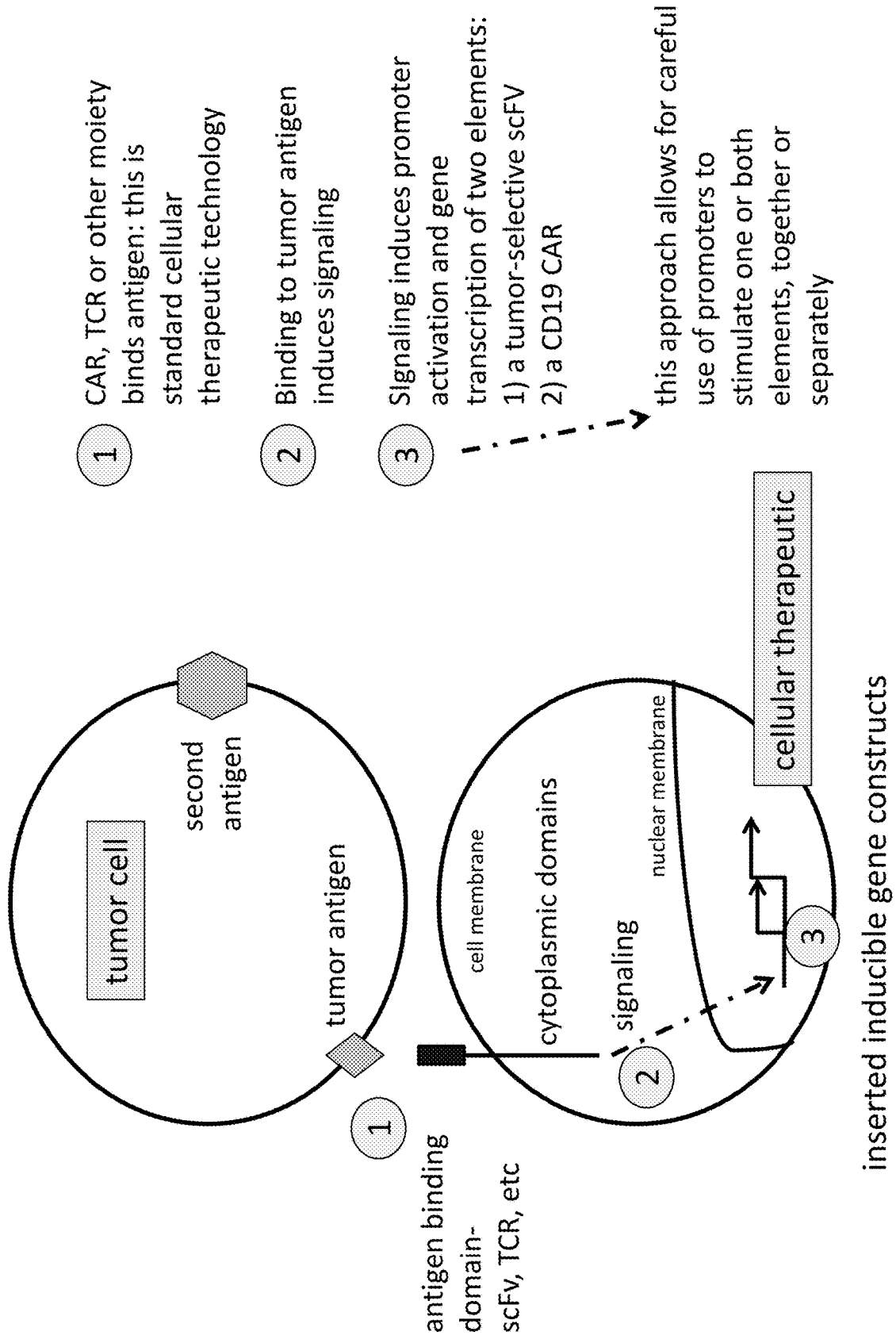
FIG. 4 is a schematic depicting an exemplary "self amplifying" cellular therapeutic encoding an inducible scFv-CD19 fusion protein and an inducible CAR that targets CD19.
Figure 4:
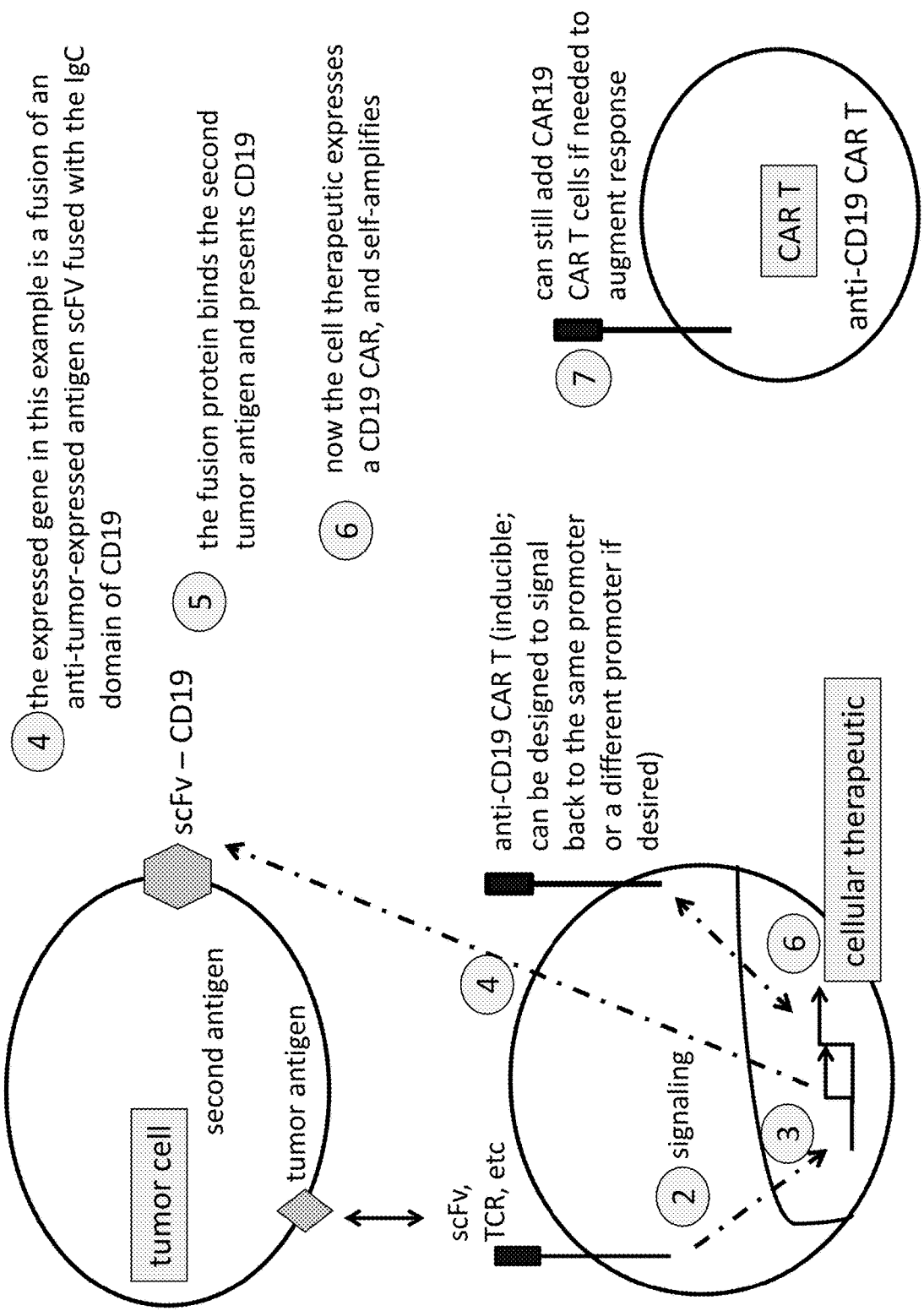

Another exemplary cellular therapeutic is depicted in FIG. 4. As shown in FIG. 4, a cellular therapeutic includes a first antigen binding receptor on its surface, which includes a first antigen binding domain (e.g., an antigen binding domain described herein) and a signaling domain (e.g., a signaling domain described herein). The cellular therapeutic additionally includes an inducible expression construct (e.g., an inducible expression construct described herein), which encodes two proteins: (i) an scFv-CD19 fusion protein; and (ii) a CAR that includes a second antigen-binding domain (which binds CD19). Upon binding of the first antigen binding domain to a first antigen on a tumor cell, the signaling domain induces expression of the scFv-CD19 fusion protein and of the CAR. The scFv portion of the scFv-CD19 fusion protein binds to a second antigen on the tumor cell, localizing CD19 (i.e., the scFv fusion partner) to the tumor cell. The tumor cell is thus "decorated" with CD19. The cellular therapeutic subsequently binds to the CD19 of the scFv-CD19 fusion protein (which is bound to the tumor cell), mediated by expression of the CAR. Alternatively or additionally, an additional cellular therapeutic (i.e., a CAR-T that includes an antigen binding domain that binds to CD19) can be used to bind to CD19 of the scFv-CD19 fusion protein (which is bound to the tumor cell), and kill the CD19-"decorated" tumor cell.

In some embodiments, the scFv-CD19 fusion protein and the CAR can be expressed at the same time (e.g., using the same or separate promoters), or can be expressed at different times. In some embodiments, an inducible expression construct includes a first promoter to express the scFv-CD19 fusion protein, and includes a second promoter to express a second CAR. For example, a first promoter can mediate rapid expression of the scFv-CD19 fusion protein, and a second promoter can mediate delayed expression of the second CAR.

Figure 5:
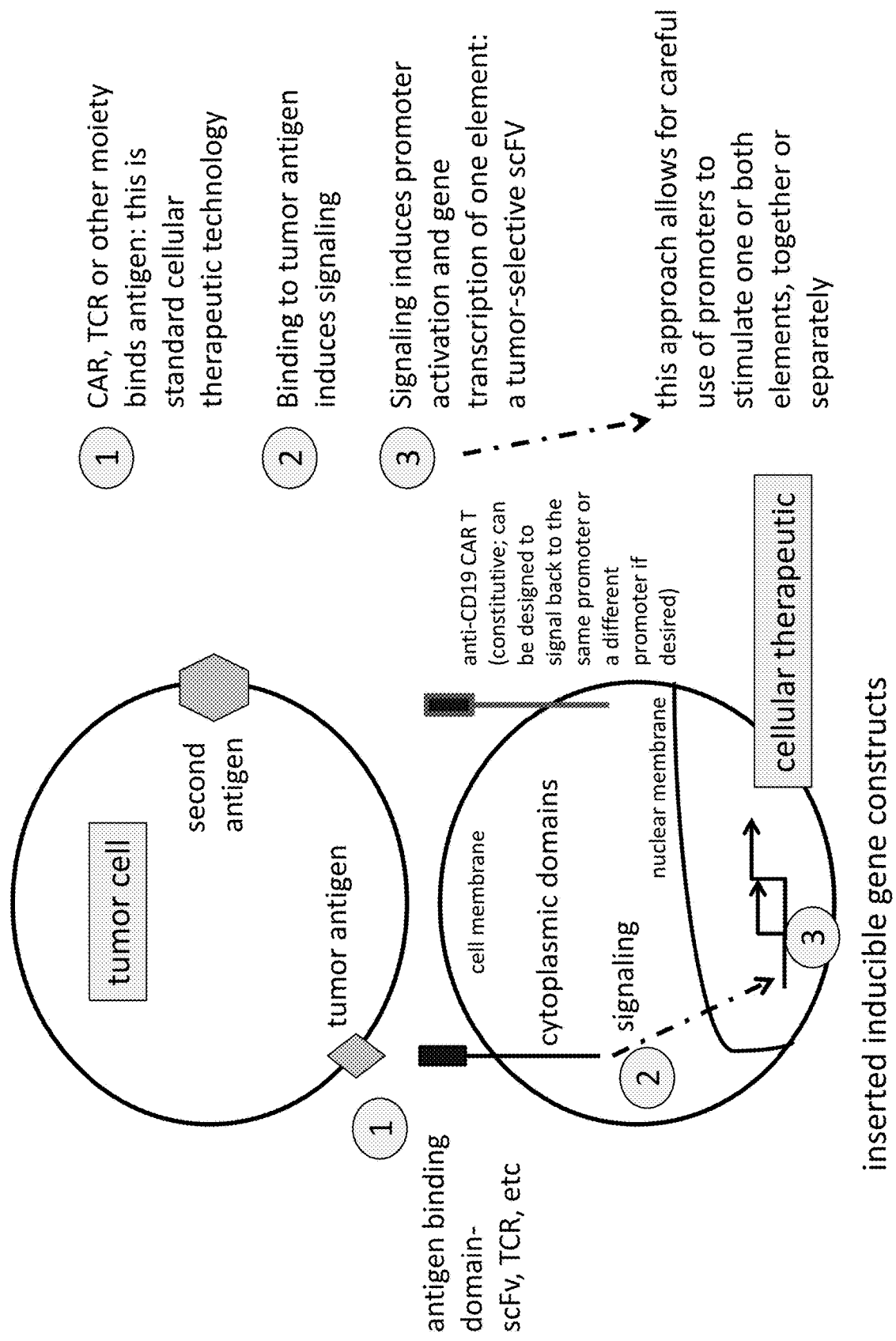
FIG. 5 is a schematic depicting an exemplary "self amplifying" cellular therapeutic encoding an inducible scFv-CD19 fusion protein and a constitutively expressed CAR that targets CD19.
Figure 5:
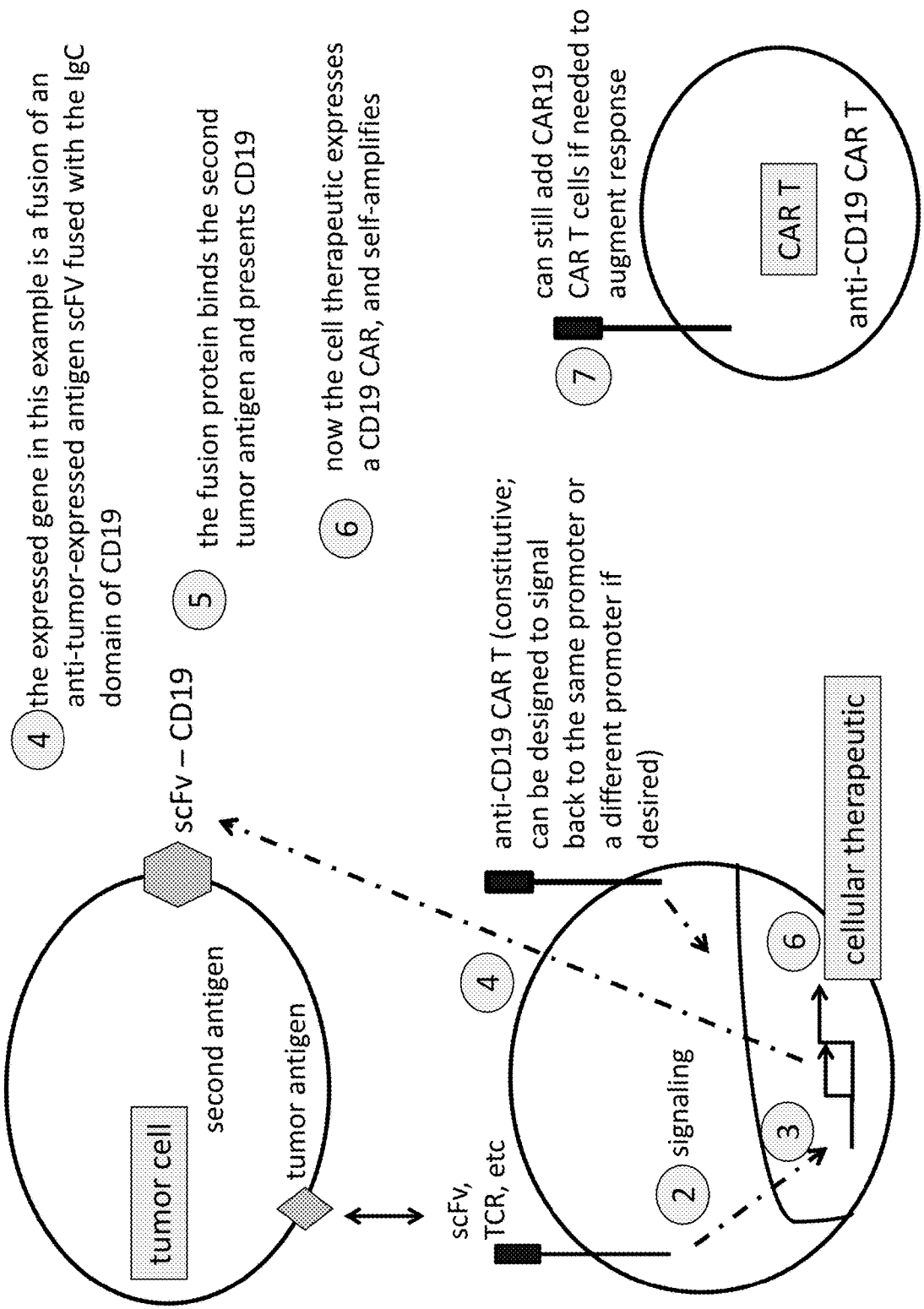

In some embodiments, a CAR includes a second signaling domain that can lead to constitutive or inducible expression of the scFv-CD19 fusion protein and/or the CAR (e.g., to "self-amplify" the cellular therapeutic). FIG. 5 depicts an exemplary cellular therapeutic that encodes a constitutively expressed CAR. As shown in FIG. 5, a cellular therapeutic includes a first antigen binding receptor on its surface, which includes a first antigen binding domain (e.g., an antigen binding domain described herein) and a signaling domain (e.g., a signaling domain described herein). The cellular therapeutic additionally constitutively expresses a CAR that includes a second antigen-binding domain (which binds CD19). The cellular therapeutic also includes an inducible expression construct (e.g., an inducible expression construct described herein), which encodes an scFv-CD19 fusion protein. Upon binding of the first antigen binding domain to a first antigen on a tumor cell, the signaling domain induces expression of the scFv-CD19 fusion protein. The scFv portion of the scFv-CD19 fusion protein binds to a second antigen on the tumor cell, localizing CD19 (i.e., the scFv fusion partner) to the tumor cell. The tumor cell is thus "decorated" with CD19. The cellular therapeutic subsequently binds to the CD19 of the scFv-CD19 fusion protein (which is bound to the tumor cell), mediated by the constitutively expressed CAR. In this embodiment, the cellular therapeutic is self-amplifying because the CAR targeting CD19 triggers release of more scFv-CD19 fusion protein. Alternatively or additionally, an additional cellular therapeutic (i.e., a CAR-T that includes an antigen binding domain that binds to CD19) can be used to bind to CD19 of the scFv-CD19 fusion protein (which is bound to the tumor cell), and kill the CD19-"decorated" tumor cell.

Figure 6:
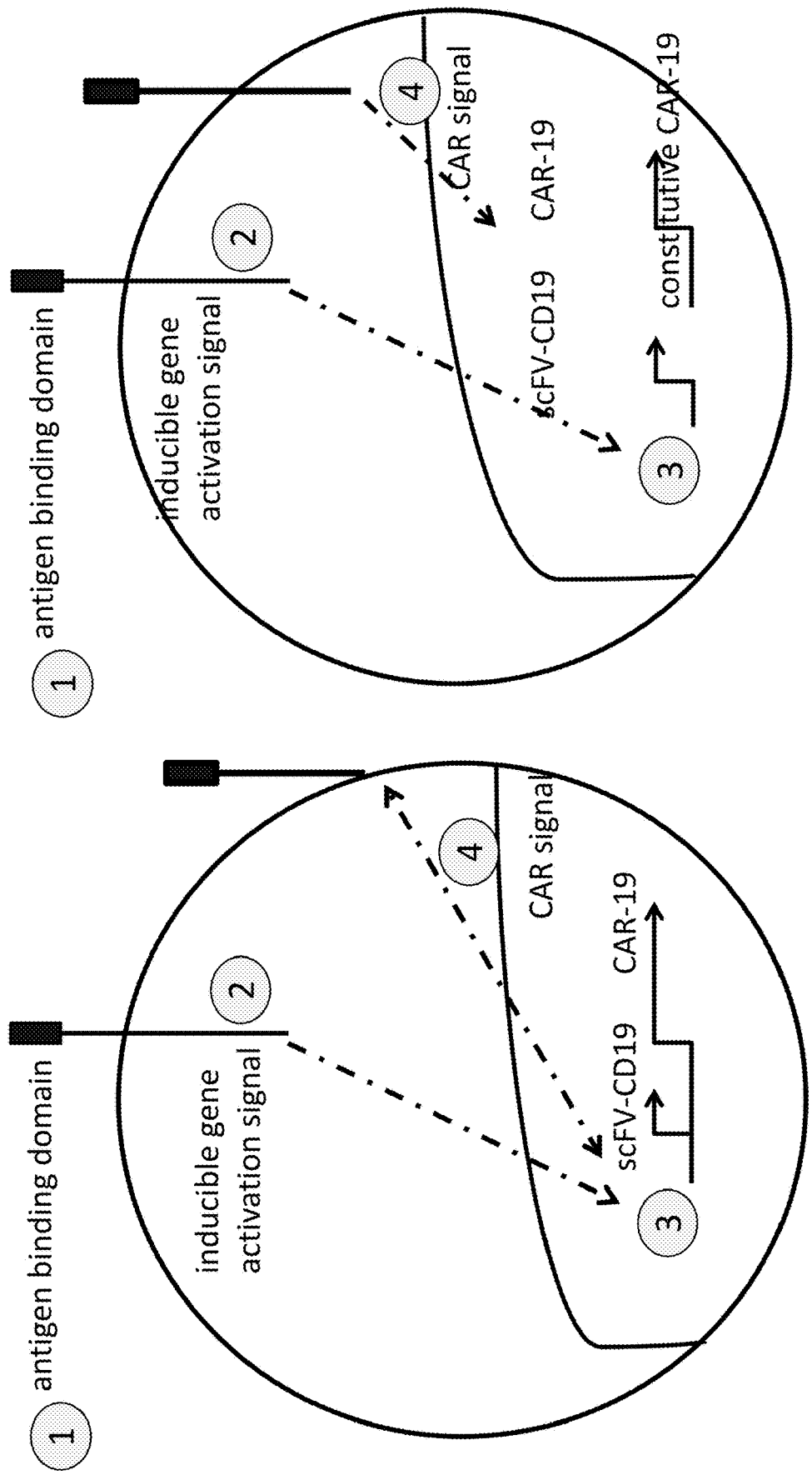
FIG. 6 is a schematic depicting an exemplary "self amplifying" cellular therapeutic expressing an antigen binding receptor that does not include a signaling domain leading to induction of killing, and does include a signaling domain sufficient to induce gene transcription, and also encoding an inducible scFv-CD19 fusion protein and an inducible CAR (left) or a constitutively expressed CAR (right) that targets CD19.

Another exemplary cellular therapeutic is depicted in FIG. 6. As shown in FIG. 6, a cellular therapeutic includes a first antigen binding receptor on its surface, which includes a first antigen binding domain (e.g., an antigen binding domain described herein) and a signaling domain that does not induce killing (e.g., the antigen binding receptor is not a CAR). The cellular therapeutic shown in FIG. 6 (left) additionally includes an inducible expression construct (e.g., an inducible expression construct described herein), which encodes two proteins: (i) an scFv-CD19 fusion protein; and (ii) a CAR that includes a second antigen-binding domain (which binds CD19). Upon binding of the first antigen binding domain to a first antigen on a tumor cell, the signaling domain induces expression of the scFv-CD19 fusion protein and of the CAR. The scFv portion of the scFv-CD19 fusion protein binds to a second antigen on the tumor cell, localizing CD19 (i.e., the scFv fusion partner) to the tumor cell. The tumor cell is thus "decorated" with CD19. The cellular therapeutic subsequently binds to the CD19 of the scFv-CD19 fusion protein (which is bound to the tumor cell), mediated by expression of the CAR.

The cellular therapeutic shown in FIG. 6 (right) additionally constitutively expresses a CAR that includes a second antigen-binding domain (which binds CD19) and also includes an inducible expression construct (e.g., an inducible expression construct described herein), which encodes an scFv-CD19 fusion protein. Upon binding of the first antigen binding domain to a first antigen on a tumor cell, the signaling domain induces expression of the scFv-CD19 fusion protein. The scFv portion of the scFv-CD19 fusion protein binds to a second antigen on the tumor cell, localizing CD19 (i.e., the scFv fusion partner) to the tumor cell. The tumor cell is thus "decorated" with CD19. The cellular therapeutic subsequently binds to the CD19 of the scFv-CD19 fusion protein (which is bound to the tumor cell), mediated by the constitutively expressed CAR.

Figure 7:
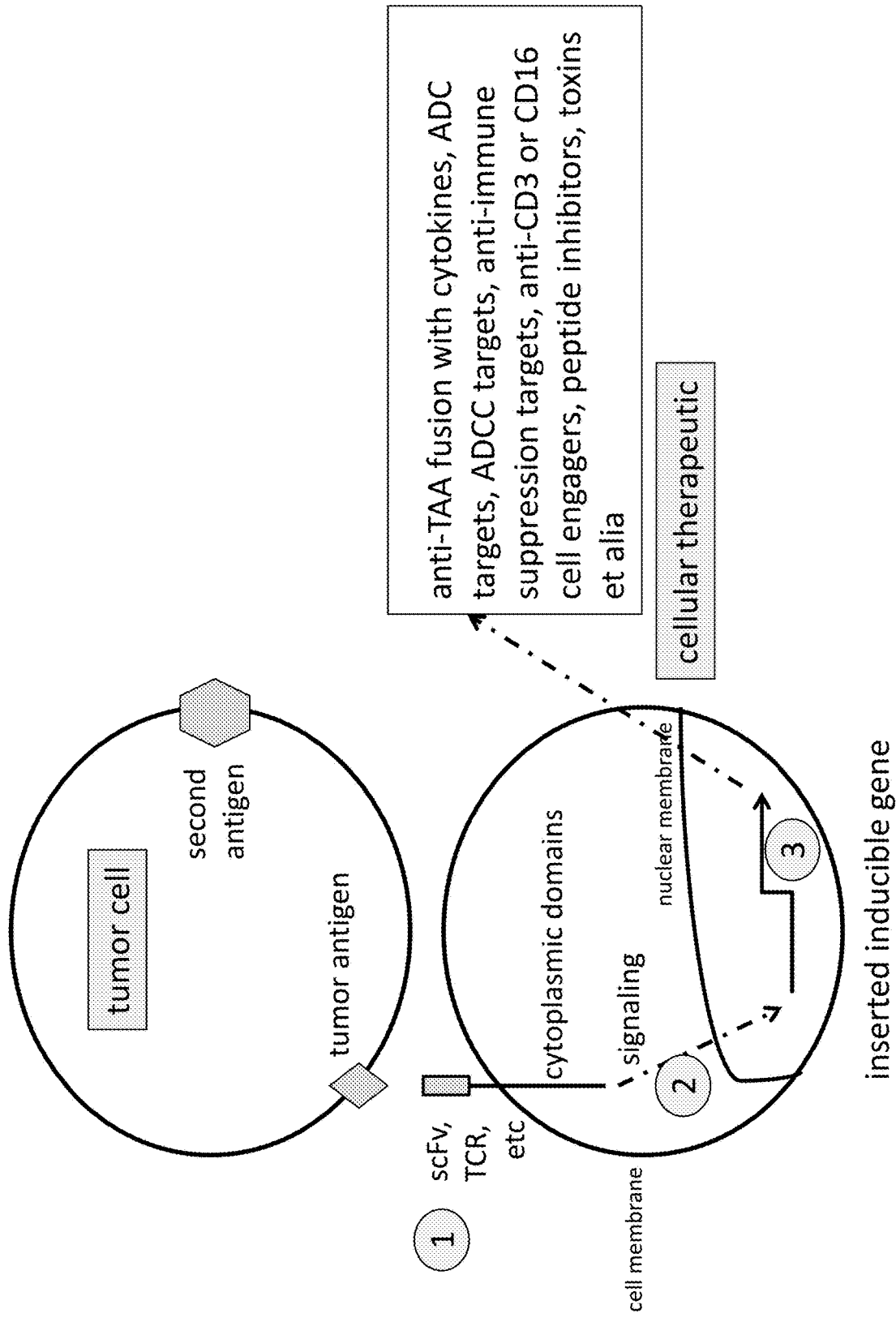
FIG. 7 is a schematic depicting an exemplary cellular therapeutic encoding various inducible genes.

FIG. 7 depicts additional exemplary cellular therapeutics that include inducible expression constructs including various genes.

Another exemplary cellular therapeutic includes an antigen binding receptor described herein and also includes an inducible expression construct (e.g., an inducible expression construct described herein), which encodes an scFv-CD19 fusion protein. The scFv portion of the fusion protein binds to a tumor antigen. Upon binding of the antigen binding domain to an antigen on a tumor cell (e.g., after administration to a subject), the signaling domain induces expression of the scFv-CD19 fusion protein. The scFv portion of the fusion protein binds to a second antigen on the tumor cell, localizing CD19 (i.e., the scFv fusion partner) to the tumor cell. In this exemplary embodiment, BLINCYTO®

(blinatumomab; Amgen) is subsequently administered to target T cells to CD19 (which is bound to the tumor cell).

In some embodiments, a constitutive expression construct encodes a fusion protein or Fc-based construct described herein that includes an antigen-binding protein (that targets a B cell antigen) fused to CD19, or a portion. In some embodiments, a constitutive expression construct encodes a B cell specific antibody (or portion thereof)/CD19 fusion protein, or a CD19/B-cell specific antibody (or portion) fusion protein. An antigen-binding protein (e.g., B-cell specific antibody) can bind to any known B cell antigen, e.g., a B cell antigen described herein (e.g., CD19, CD20, CD21, CD22, CD72, CD79a, CD79b, BCMA, or CD180). In some embodiments, a constitutive expression construct encodes an scFv/CD19 fusion protein, e.g., an anti-CD20 scFv/CD19 fusion protein or an anti-CD20 scFv/CD19 fragment fusion protein. In some embodiments, a constitutive expression construct encodes a CD19/scFv fusion protein, e.g., a CD19/anti-CD20 scFv fusion protein, or a CD19 fragment/anti-CD20 scFv fusion protein.

In some embodiments, a constitutive expression construct encodes a fusion protein or Fc-based construct described herein that includes an antigen-binding protein (that targets a B cell antigen) fused to a B cell antigen or portion. In some embodiments, a constitutive expression construct encodes a B cell specific antibody (or portion thereof)/B cell antigen (or portion) fusion protein, or a B cell antigen (or portion)/B-cell specific antibody (or portion) fusion protein. In some embodiments, a constitutive expression construct encodes a fusion protein that includes (i) CD22 or portion (e.g., one or more of domains 1-3), CD79 or portion (e.g., CD79a or CD79b), and (ii) a B cell specific antibody or portion (e.g., an anti-CD19, CD20, CD21, CD22, CD72, CD79a, CD79b, BCMA, or CD180 scFv).

In some embodiments, a constitutive expression construct encodes a fusion protein or Fc-based construct described herein that includes an antigen-binding protein (that targets a B cell antigen) fused to CD20 (or portion). In some embodiments, a constitutive expression construct encodes a fusion protein that includes a B cell specific antibody (or portion thereof) and CD20 (or portion). In some embodiments, a constitutive expression construct encodes a fusion protein that includes a B cell specific antibody (or portion thereof) and a portion of CD20 that is or includes an epitope of CD20 (as described in, e.g., Natarajan et al., Clin. Cancer Res. 19:6820-9 (2013)).

In some embodiments, a constitutive expression construct encodes a fusion protein or Fc-based construct described herein that includes an antigen-binding protein (that targets a TSA or TAA) and CD19, or portion. In some embodiments, a constitutive expression construct encodes an anti-TSA antibody (or portion thereof)/CD19 fusion protein, or a CD19/anti-TSA antibody (or portion) fusion protein. An anti-TSA antibody can bind to any known TSA, e.g., any TSA described herein. In some embodiments, a TSA is EGFRvIII splice variant. In some embodiments, a constitutive expression construct encodes an scFv/CD19 fusion protein, e.g., an anti-EGFRvIII scFv/CD19 fusion protein or an anti-EGFRvIII scFv/CD19 fragment fusion protein. In some embodiments, a constitutive expression construct encodes a CD19/scFv fusion protein, e.g., a CD19/anti-EGFRvIII scFv fusion protein, or a CD19 fragment/anti-EGFRvIII scFv fusion protein.

In some embodiments, a constitutive expression construct encodes a fusion protein or Fc-based construct described herein that includes an antigen-binding protein (that targets a TSA or TAA) and a B cell antigen or portion. In some embodiments, a constitutive expression construct encodes an anti-TSA antibody (or portion thereof)/B cell antigen fusion protein, or a B cell antigen/anti-TSA antibody. An antigen-binding protein (e.g., anti-TSA antibody) can bind to any known TSA, e.g., any TSA described herein. In some embodiments, a TSA is EGFRvIII splice variant. In some embodiments, a constitutive expression construct encodes a fusion protein that includes (i) an anti-EGFRvIII scFv and (ii) a B cell antigen or portion (e.g., CD20 or portion (e.g., an epitope as described in, e.g., Natarajan et al., Clin. Cancer Res. 19:6820-9 (2013), CD22 or portion (e.g., one or more of domains 1-3), CD79 or portion (e.g., CD79a or CD79b)).

In some embodiments, a constitutive expression construct encodes one or more antibodies (or fragments) described herein. In some embodiments, an inducible expression construct encodes one or more antibodies (or fragments) described herein. In some embodiments, an antibody described herein as encoded by an expression construct can additionally or alternatively be produced and/or purified using known methods. In some embodiments, such produced and/or purified antibody can be used, as described herein, as a protein therapeutic.

3. Expressed Cytokines

In some embodiments, an expression construct described herein (e.g., a constitutive expression construct or inducible expression construct) encodes one or more cytokines, e.g., one or more cytokines known in the art, e.g., used in cancer therapy. In some embodiments, an expression construct that encodes one or more cytokines is an inducible expression construct. In some embodiments, an expression construct that encodes one or more cytokines is a constitutive expression construct. Nonlimiting, exemplary cytokines that can be included in an expression construct include, e.g., IFNα, IFNβ, IFNγ, IL-1, IL-2, IL-7, IL-12, IL-15, IL-21, IL-36, TNF, LTα, GM-CSF, and G-CSF. Cytokines participate in immune responses by acting through various mechanisms, including recruitment of T cells toward a tumor. Nucleotide sequences encoding cytokines are known, and such nucleotide sequence can be from any animal, such as human, ape, rat, mouse, hamster, dog, or cat.

Known problems associated with cytokine therapy include, e.g., high dose requirements, toxicity, and limited efficacy. Thus, in some embodiments, an expression construct described herein is used to deliver one or more cytokines at a specific site and/or at a specific dose (e.g., to reduce or eliminate one or more risks associated with cytokine therapy). In some embodiments, an expression construct includes a promoter operably linked to a gene encoding a cytokine, and the promoter mediates rapid, sustained expression. In some embodiments, an expression construct includes a promoter operably linked to a gene encoding a cytokine, and the promoter mediates delayed, late-inducible expression. In some embodiments, an expression construct includes a promoter operably linked to a gene encoding a cytokine, and the promoter mediates rapid, transient expression.

In some embodiments, expression of a cytokine (e.g., an immunostimulatory cytokine) at or near a surface of a tumor induces an immune response to the tumor. In some embodiments, an expressed cytokine can be a target for one or more additional cellular therapeutics (e.g., one or more additional CAR-T cells). In some embodiments, expression of a cytokine near a surface of a tumor induces an immune response to the tumor and is also used as a target for one or more additional cellular therapeutics (e.g., one or more additional CAR-T cells).

For example, release of IL-21 can be used to induce expansion and/or effector differentiation of CD8+ T cells and/or support NK cell activation and cytolytic activity. In one exemplary method, a cellular therapeutic includes an expression construct that includes a CD69 promoter and a nucleic acid encoding IL-21. In some embodiments, upon binding of an antigen on a tumor cell, a cellular therapeutic described herein exhibits prolonged release of IL-21. In some embodiments, IL-21 is constitutively expressed by the cellular therapeutic after administration of the cellular therapeutic to a subject. Exemplary cellular therapeutics include, e.g., CAR-T cells, CAR-NK cells, TCR-T cells, TIL cells, allogenic NK cells, and autologous NK cells.

Figure 8:
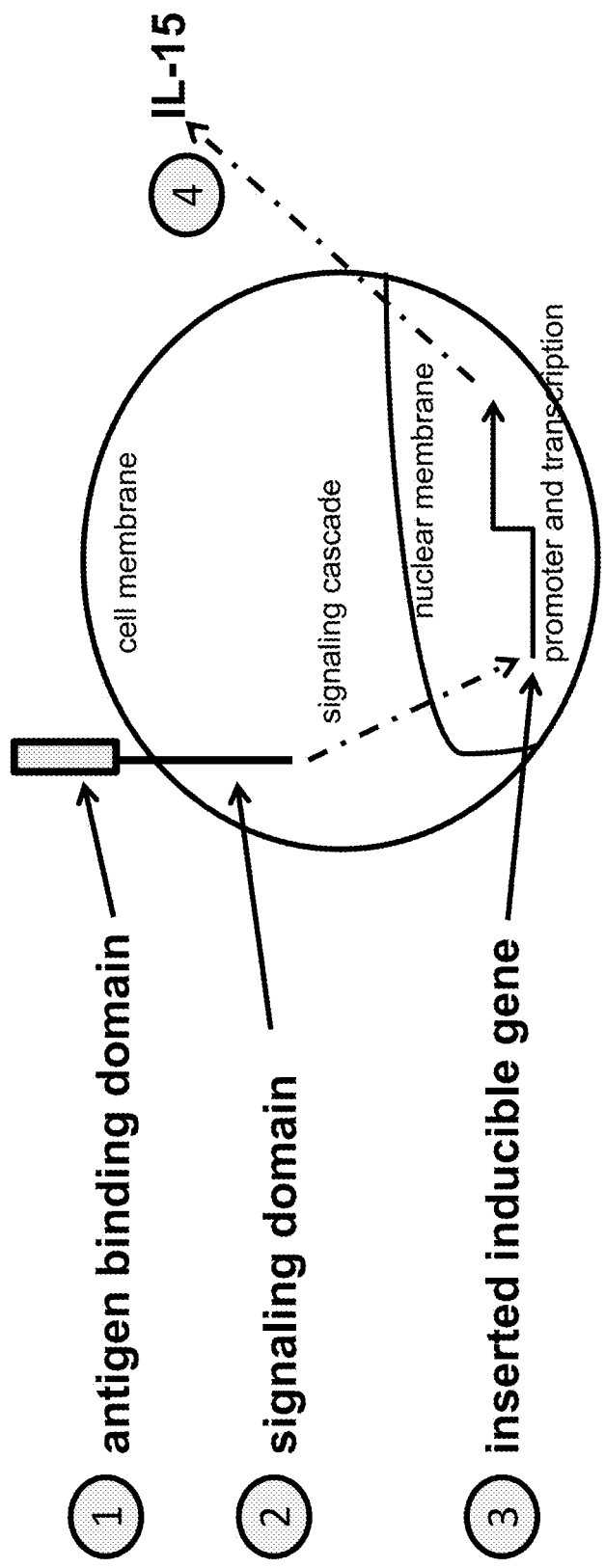
FIG. 8 is a schematic depicting an exemplary cellular therapeutic encoding an inducible cytokine.

In another exemplary method, release of IL-15 can be used to support NK cell expansion and/or to recruit NK cells to promulgate an anti-tumor response. FIG. 8 depicts an exemplary cellular therapeutic that includes an inducible expression construct that includes a TNF promoter and a nucleic acid encoding IL-15. Upon binding of an antigen on a tumor cell, the cellular therapeutic exhibits secretion (e.g., rapid secretion) of IL-15. Exemplary cellular therapeutics include, e.g., CAR-T cells, CAR-NK cells, TCR-T cells, TIL cells, allogenic NK cells, and autologous NK cells.

In some embodiments, one or more cytokines encoded by an expression construct bind to cells at high affinity (e.g., KD of about $10^{-7}$, $10^{-8}$, $10^{-9}$, $10^{-10}$, $10^{-11}$, or less) and/or have low internalization rates (e.g., less than about 10, $10^2$, $10^3$, $10^4$, or $10^5$ cytokine molecules per cell per day). Binding affinity and internalization rates of various cytokines are known in the art and/or can be measured using known methods.

In some embodiments, an expression construct described herein (e.g., a constitutive expression construct or inducible expression construct) encodes a cytokine fusion protein, e.g., a fusion protein of a cytokine (e.g., an anti-tumor cytokine) and a target for one or more additional cellular therapeutics described herein (e.g., a CAR-T target). Such an expression construct can provide both a target for one or more additional cellular therapeutics (e.g., a CAR-T target) and a stimulatory cytokine at a tumor surface. For example, an expression construct can encode a cytokine-CD19 fusion protein, or a fusion of a cytokine and a CD19 fragment, e.g., a CD19 fragment to which a CD19–CAR-T cell binds. In some embodiments, a CD19 fragment is a CD19 IgC domain. Without wishing to be bound by theory, a single expression construct encoding such a fusion protein advantageously allows a cellular therapeutic to be genetically engineered using a minimal (e.g., a single) transgene.

In some embodiments, a non-inducible expression construct encodes one or more cytokines or cytokine fusion proteins described herein. In some embodiments, an inducible expression construct encodes one or more cytokines or cytokine fusion proteins described herein. In some embodiments, a cytokine fusion protein described herein as encoded by an expression construct can additionally or alternatively be produced and/or purified using known methods. In some embodiments, such produced and/or purified fusion protein can be used, as described herein, as a protein therapeutic.

4. Expressed Scaffold Fusion Proteins

In some embodiments, an expression construct described herein (e.g., a constitutive expression construct or inducible expression construct) encodes a fusion protein comprising a scaffold polypeptide (or fragment thereof) and a target for one or more additional cellular therapeutics described herein (e.g., a CAR-T target). A scaffold polypeptide (or fragment) can be selected to bind, e.g., to a tumor antigen (e.g., a tumor antigen described herein). Such scaffold polypeptides (or fragments) include, e.g., fibronectin domain (e.g., a Type III fibronectin domain), a DARPin, an adhiron, a lipocalin/anticalin, protein A, an affibody, thioredoxin, etc. For example, an expression construct can encode a Type III fibronectin domain-CD19 fusion protein, or a fusion of a Type III fibronectin domain and a CD19 fragment, e.g., a CD19 fragment to which a CD19-CAR-T cell binds. In some embodiments, a CD19 fragment is a CD19 IgC domain.

In some embodiments, a constitutive expression construct encodes one or more scaffold fusion proteins described herein. In some embodiments, an inducible expression construct encodes one or more scaffold fusion proteins described herein. In some embodiments, a scaffold fusion protein described herein can additionally or alternatively be produced and/or purified using known methods. In some embodiments, such produced and/or purified scaffold fusion protein can be used, as described herein, as a protein therapeutic.

5. CD19 as a Scaffold for Expressed CD19 Variant Proteins and CD19 Variant Fusion Proteins CD19 is a 95 kd transmembrane glycoprotein belonging to the Ig superfamily and includes two extracellular C2-type Ig domains (see, e.g., Tedder Nature Rev. Rheum. 5:572-577 (2009); Wang et al., Exp. Hematol. Oncol. 2012 Nov. 29; 1(1):36. doi: 10.1186/2162-3619-1-36.)). In some embodiments, the extracellular domain (ECD) of CD19, and/or one or both of the C2-type Ig domains are used as scaffolds for mutagenesis, and CD19 variants (e.g., CD19 or a portion thereof that include one or more mutations within the ECD and/or one or both C2-type Ig domains) can be screened and selected for binding to a target antigen described herein.

The nucleotide sequence of human CD19 is known (see GENBANK® Accession No. M84371.1). To provide variant nucleic acid sequences that encode CD19 variants that bind a particular antigen, a number of methods known in the art may be utilized. In some embodiments, a screening procedure is used that enables identification and/or isolation of nucleic acids that encode CD19 variants that bind a particular antigen. Exemplary methods include a so-called biopanning step, known from technologies such as phage display (Kang, A. S. et al. 1991. Proc Natl Acad Sci USA 88, 4363-4366), ribosome display (Schaffitzel, C. et al. 1999. J. Immunol. Methods 231, 119-135), DNA display (Cull, M. G. et al. 1992. Proc Natl Acad Sci USA 89, 1865-1869), RNA-peptide display (Roberts, R. W., Szostak, J. W., 1997. Proc Natl Acad Sci USA 94, 12297-12302), covalent display (WO 98/37186), bacterial surface display (Fuchs, P. et al. 1991. Biotechnology 9, 1369-1372), yeast surface display (Boder, E. T., Wittrup, K. D., 1997. Nat Biotechnol 15, 553-557) and eukaryotic virus display (Grabherr, R., Ernst, W., 2001. Comb. Chem. High Throughput. Screen. 4, 185-192). FACS and magnetic bead sorting are also applicable for enrichment (panning) purposes using labeled antigen. Immunodetection assays such as ELISA (Dreher, M. L. et al. 1991. J. Immunol. Methods 139, 197-205) and ELISPOT (Czerkinsky, C. C. et. al. 1983. J Immunol Methods. 65, 109-21) can also be used either following a biopanning step or alone.

Figure 12:
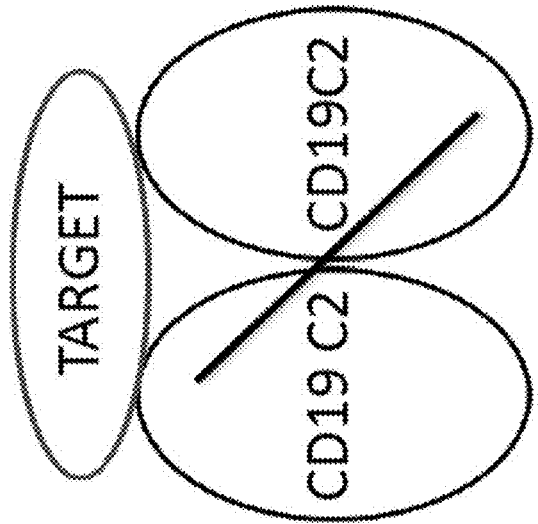
FIGS. 12A, 12B, and 12C are schematics depicting exemplary CD19 variants.

Thus, in some embodiments, an expression construct described herein (e.g., a constitutive expression construct or inducible expression construct) encodes a CD19 variant (or fragment), either alone or as part of a fusion protein described herein. For example, an expression construct described herein can encode a CD19 variant (or fragment) selected to bind to a tumor agent and which, upon expression, can bind to the tumor antigen and that itself can be a target for an additional cellular therapeutic (e.g., a CAR-T cell that binds CD19). In some embodiments, a CD19 variant (or fragment) can comprise one or more mutations, relative to wildtype CD19, within the ECD and/or one or both Ig domains. In some embodiments, an expression construct described herein encodes a CD19 variant that includes an ECD variant or a C2-type Ig domain variant selected to bind a tumor antigen. Upon expression of the CD19 variant, the ECD or C2-type Ig domain binds to the tumor antigen on a tumor cell. Subsequently, treatment with (e.g., administration to a subject of) a CAR-T cell that recognizes CD19 kills the tumor cell to which the CD19 variant is bound. An example of such a CD19 variant is depicted in FIG. 12A.

In some embodiments, an expression construct described herein encodes a CD19 variant that includes variants of both C2-type Ig domains, each of which is selected to bind a tumor antigen (e.g., different epitopes of the tumor antigen). Upon expression of the CD19 variant, the C2-type Ig domains bind to the tumor antigen on a tumor cell. Subsequently, treatment with (e.g., administration to a subject of) a CAR-T cell that recognizes CD19 kills the tumor cell to which the CD19 variant is bound. An example of such a CD19 variant is depicted in FIG. 12B.

In some embodiments, a CD19 variant selected for binding to a target antigen is included in a fusion protein. For example, a CD19 variant that includes an ECD variant or C2-type Ig domain variant selected to bind a tumor antigen can be fused to an antibody or fragment thereof that also binds to the tumor antigen (e.g., to a different epitope on the tumor antigen). Exemplary fusion proteins include, e.g., CD19 variant/scFv fusion proteins and CD19 variant/VHH fusion proteins. An expression construct described herein can encode such a CD19 variant/antibody fusion protein and upon expression, the CD19 variant and the antibody of the fusion protein bind to the tumor antigen on a tumor cell. Subsequently, treatment with (e.g., administration to a subject of) a CAR-T cell that recognizes CD19 kills the tumor cell to which the CD19 variant/antibody fusion protein is bound. An example of such a CD19 variant is depicted in FIG. 12C.

In some embodiments, a constitutive expression construct encodes one or more CD19 variant proteins or CD19 variant fusion proteins described herein. In some embodiments, an inducible expression construct encodes one or more CD19 variant proteins or CD19 variant fusion proteins described herein. In some embodiments, a CD19 variant protein or CD19 variant fusion protein described herein can additionally or alternatively be produced and/or purified using known methods. In some embodiments, such produced and/or purified CD19 variant protein or CD19 variant fusion protein can be used, as described herein, as a protein therapeutic.

Additional, non-limiting examples of fusion proteins that include CD19 variants (or fragment) as a scaffold include, e.g., CD19 variant/cytokine fusion proteins and CD19 variant/TLR agonist fusion proteins.

6. B Cell-Specific Markers and Additional Proteins as Scaffolds

In addition to CD19, other B cell specific markers belonging to the Ig superfamily can also be used as scaffolds for mutagenesis, and B cell specific marker variants can be screened and selected for binding to a target antigen described herein. In some embodiments, a B cell specific marker is CD19, CD20, CD21, CD22, CD23, CD24, CD40, CD72, CD180, ROR1, BCMA, CD79a, or CD79b (see, e.g., LeBien et al., Blood 112:1570-1580 (2008)).

For example, CD22 contains 7 Ig domains, each of which can be mutated individually or in combination with one or more other CD22 Ig domains and screened using methods described herein to bind to a tumor antigen. In some embodiments, a CD22 variant or fragment includes the first 1, 2, 3, 4, 5, 6, or all 7 Ig domains (e.g., domains 1-3). In some embodiments, a CD22 variant (or fragment) can comprise one or more mutations, relative to wildtype CD22, within each of one or more CD22 Ig domains (e.g., CD22 domains 1 and 2, or CD22 domains 1 thru 3, etc.). Thus, in some embodiments, an expression construct described herein encodes a CD22 variant (or fragment), either alone or as part of a fusion protein described herein. For example, an expression construct described herein can encode a CD22 variant (or fragment) selected to bind to a tumor agent and which, upon expression, can bind to the tumor antigen and that itself can be a target for an additional cellular therapeutic (e.g., a CAR-T cell that binds CD22). Similarly, CD79a and CD79b each consist of a single Ig domain, each of which can be mutated and screened using methods described herein to bind to a tumor antigen. Thus, in some embodiments, an inducible expression construct described herein encodes a CD79a or CD79b variant, either alone or as part of a fusion protein described herein. For example, an expression construct described herein can encode a CD79 variant selected to bind to a tumor agent and which, upon expression, can bind to the tumor antigen and that itself can be a target for an additional cellular therapeutic (e.g., a CAR-T cell that binds CD79a or CD79b).

Additional B cell specific proteins that can be used as a scaffold as described herein include the C-type lectins CD23 and CD72 (see, e.g., LeBien et al., Blood 112:1570-1580 (2008)). As a precedent, another C-type lectin tetranectin (see, e.g., Byla et al., JBC 285:12096-12100 (2010)) has been used successfully as a scaffold protein. Accordingly, in some embodiments, an expression construct described herein encodes a CD23 or CD72 variant (or fragment), either alone or as part of a fusion protein described herein. For example, an expression construct described herein can encode a fusion protein comprising a CD23 or CD72 variant (or fragment) selected to bind to a tumor antigen and which, upon expression, can bind to the tumor antigen. The fusion protein can further comprise a polypeptide target for an additional cellular therapeutic (e.g., a CAR-T cell that binds the polypeptide target).

7. Expressed Toxins

In some embodiments, an expression construct described herein (e.g., a constitutive expression construct or inducible expression construct) encodes one or more toxins. In some such embodiments, an expression construct is designed such that timing of expression of the encoded toxin is controlled (e.g., producing a "smart bomb" cellular therapeutic). For example, an expression construct can include an appropriate promoter to mediate delayed expression of an encoded toxin (e.g., a VLA1 promoter), or an expression construct can include an appropriate promoter to mediate rapid and/or transient expression (e.g., a TNF promoter)).

A nucleotide sequence encoding any known protein toxin can be included in an inducible expression construct, e.g., bacterial toxins such as diphtheria toxin and plant toxins such as ricin. Additional enzymatically active toxins and fragments thereof that can be used include diphtheria A chain, nonbinding active fragments of diphtheria toxin, anthrax toxin, shiga toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin and the tricothecenes. See, for example, WO 93/21232.

In some embodiments, expression and/or delivery of a toxin to a target cell is controlled by administering or contacting a target cell with a defined number of cellular therapeutic cells that include an expression construct encoding a toxin. For example, a population of cellular therapeutic cells can be administered to a subject and/or contacted with a target cell. In some embodiments, such population includes a ratio of cellular therapeutic cells that include an expression construct and cellular therapeutic cells that do not include an expression construct. For example, a population having a ratio of expression construct—containing cellular therapeutic cells and cellular therapeutic cells lacking an expression construct of about 1:10, 1:100, 1:1000, 1:10000, 1:100000, or more, can be administered.

In some embodiments, delivery of a toxin by a cellular therapeutic induced to express a toxin can kill, e.g., 10, 50, 100, 250, 500, 750, 1000, 1500, 2000, or more cells near the vicinity of the target cell.

In some embodiments, an expression construct can include a "kill switch" in tandem with the nucleic acid encoding a toxin, to thereby stop expression of the toxin by the cellular therapeutic after a defined period of time (e.g., after 1, 2, 4, 8, 12 hours, or more). Safety "switches" can be used to turn off cellular therapeutics, e.g., when they cause life-threatening inflammation or attack normal healthy tissue. For example, such a "switch" can induce caspase 9-dependent apoptosis when a CAR T cell is exposed to rimiducid (a pill that can be given to patients if they develop life-threatening side effects; Bellicum Pharmaceuticals Inc.). Many such switches are known and in preclinical and clinical development and can be used in the context of the present disclosure (see for example Tey, 2014. Adoptive T-cell therapy: adverse events and safety switches. *Clinical & Translational Immunology* 3, e17; doi:10.1038/cti.2014.11).

Figure 10:
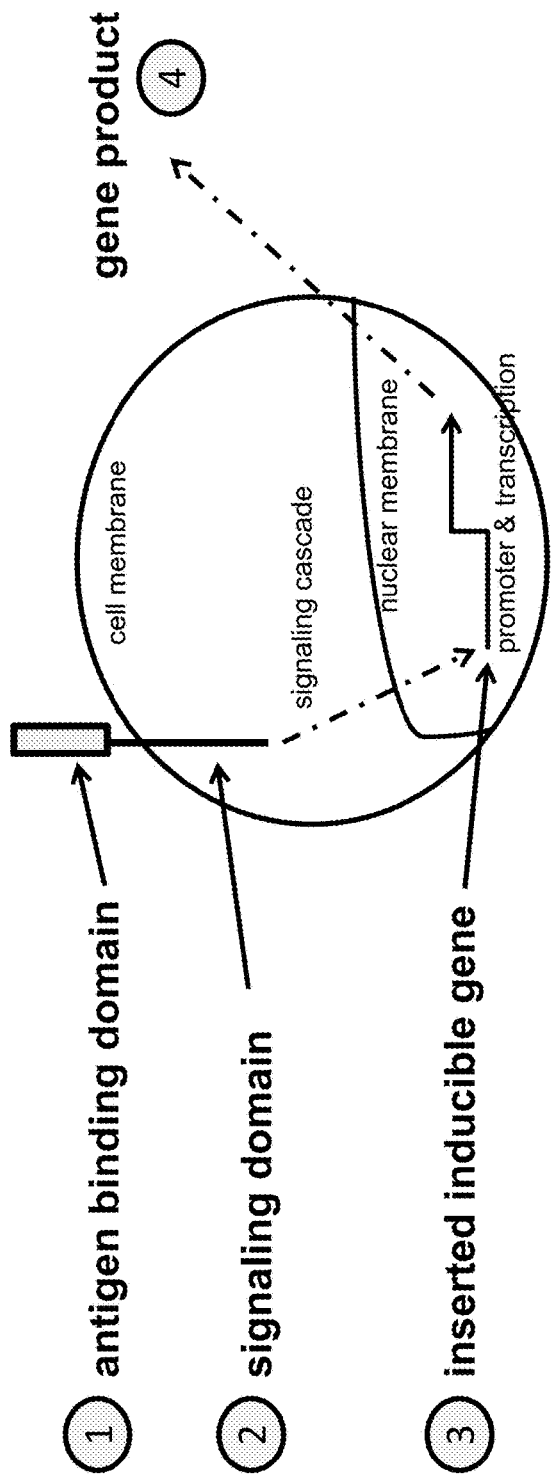
FIG. 10 is a schematic depicting an exemplary cellular therapeutic encoding an inducible toxin.

FIG. 10 depicts an exemplary cellular therapeutic that encodes an inducibly expressed toxin (e.g., diphtheria toxin, anthrax toxin, shiga toxin). As shown in FIG. 10, a cellular therapeutic includes an antigen binding receptor on its surface, which includes an antigen binding domain (e.g., an antigen binding domain described herein) and a signaling domain (e.g., a signaling domain described herein). The cellular therapeutic also includes an inducible expression construct (e.g., an inducible expression construct described herein), which encodes diphtheria toxin. Upon binding of the antigen binding domain to an antigen on a tumor cell, the signaling domain induces expression of the diphtheria toxin, leading to cell death.

8. Other Expressed Genes

In some embodiments, an expression construct (e.g., a constitutive expression construct or inducible expression construct) encodes an agent that targets a tumor microenvironment. The microenvironment of certain cancers and/or tumors are known to provide protection to the tumor against cellular therapeutic attack. For example, such protective microenvironments can include an extracellular matrix (ECM) that prevents or reduces effectiveness of cellular attack, can include hypoxic and/or acidic pH conditions, and/or can include immunosuppressive signals. In some embodiments, an expression construct encodes a protein that targets and/or mediates degradation of a tumor microenvironment. Such proteins are known in the art. For example, an expression construct can encode a hyaluronidase, a heparinase, a matrix metalloproteinase (MMP), and/or an ADAM (a disintegrin and metalloproteinase, e.g., ADAMs1-20, e.g., ADAMS, ADAM10, ADAM17) (see, e.g., Edwards et al., Mol. Aspects Med. 29:258-89 (2008); Decock et al., J. Cell. Mol. Med. 15:1254-65 (2011); McAtee et al., Adv. Cancer Res. 123:1-34 (2014); Stanton et al., Biochim. Biophys. Acta 1812:1616-1629 (2011)).

Figure 11:
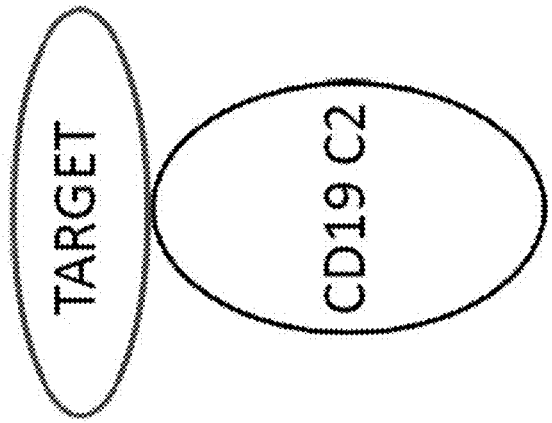
FIG. 11 is a schematic depicting an exemplary cellular therapeutic encoding various inducible genes.

FIG. 11 depicts an exemplary cellular therapeutic that encodes inducibly expressed genes. As shown in FIG. 11, a cellular therapeutic includes an antigen binding receptor on its surface, which includes an antigen binding domain (e.g., an antigen binding domain described herein) and a signaling domain (e.g., a signaling domain described herein). The cellular therapeutic also includes an inducible expression construct (e.g., an inducible expression construct described herein), which encodes a gene (e.g., a gene depicted in FIG. 11). Upon binding of the antigen binding domain to an antigen on a tumor cell, the signaling domain induces expression of gene.

In some embodiments, an inducible expression construct encodes factors for T cell and/or NK cell function and/or survival (e.g., lymphocyte expansion molecule (LEM); see, e.g., Leavy, Nat. Rev. Immunol. 15:334 (2015)).

9. Expressed Fusion Proteins with Cleavable Linkers

In some embodiments, any of the fusion proteins described herein (e.g., an scFv-CD19 fusion protein) can include a linker between the fusion partners. A variety of suitable linkers and methods for preparing fusion proteins including linkers are known in the art. The linker can be cleavable, e.g., under physiological conditions., e.g., under intracellular conditions, such that cleavage of the linker releases the fusion partners. The linker can be, e.g., a peptidyl linker that is cleaved by, e.g., a plasma peptidase or protease enzyme, including, but not limited to, aminopeptidase, plasmin, and kinin-kallikrein. In some embodiments, the linker can be cleaved by a tumor associated protease, e.g., matriptase, Cathepsin B. In some embodiments, cleavage by a tumor-associated protease induces a conformational change in CD19 allowing for binding and/or expression of the CAR epitope to allow killing. In some embodiments, the peptidyl linker is at least two amino acids long or at least three amino acids long.

10. Expressed Fc-Based Constructs

Figure 52A:
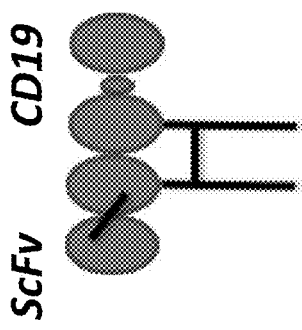
FIGS. 52A-52C show exemplary Fc-based constructs.

In some embodiments, an expression construct described herein (e.g., a constitutive expression construct or inducible expression construct) encodes an Fc-based construct. In some embodiments, an Fc-based construct is a CD19-Fc fusion protein, e.g., a construct depicted in FIG. 52A. As shown in FIG. 52A, a CD19-Fc fusion protein can be a dimer of two monomers, each of which includes all or part of a heavy chain Fc region of an antibody fused to an extracellular C2-type Ig domain-containing form of CD19. In some embodiments, a CD19-Fc fusion protein includes an ECD variant or one or two C2-type Ig domain variants described herein. In some embodiments, one or both of the extracellular C2-type Ig domains of CD19 are C2-type Ig domain variants described herein. In the exemplary embodiment depicted in FIG. 52A, both C2-type Ig domains are C2-type Ig domain variants (depicted with "**"). In some embodiments, such a construct both binds a tumor antigen (e.g., a TSA or TAA described herein) via one or both C2-type Ig domain variants (or ECD variant), and presents CD19 as a target for one or more additional therapeutics described herein (e.g., CART, ADC, etc.).

Figure 52B:

In some embodiments, an Fc-based construct is one schematically depicted in FIG. 52B, in which the construct is a CD19-scFv-Fc fusion protein. As shown in FIG. 52B, an exemplary construct is a heterodimer, where one monomer includes all or part of a heavy chain Fc region of an antibody fused to an scFv (e.g., an scFv described herein), and one monomer includes all or part of a heavy chain Fc region of an antibody fused to all or part of CD19. In some embodiments, such a construct binds to a tumor antigen (e.g., a TSA or TAA described herein) via the scFv, and presents CD19 as a target for one or more additional therapeutics described herein (e.g., CART, ADC, etc.).

Figure 52C:
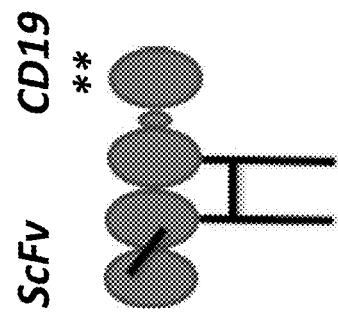

In some embodiments, an Fc-based construct is one schematically depicted in FIG. 52C, in which the construct is a CD19-scFv-Fc fusion protein. As shown in FIG. 52C, an exemplary construct is a heterodimer, where one monomer includes all or part of a heavy chain Fc region of an antibody fused to an scFv (e.g., an scFv described herein), and one monomer includes all or part of a heavy chain Fc region of an antibody fused to an extracellular C2-type Ig domain variant described herein (depicted with "**"). In some embodiments, such a construct can be bivalent, in which the scFv and C2-type Ig domain variant (or ECD variant) bind the same target (e.g., a TSA or TAA described herein), or can be bispecific, in which the scFv and C2-type Ig domain variant bind different targets (e.g., a TSA or TAA described herein). In addition, such construct presents CD19 as a target for one or more additional therapeutics described herein (e.g., CART, ADC, etc.).

Figure 53A:
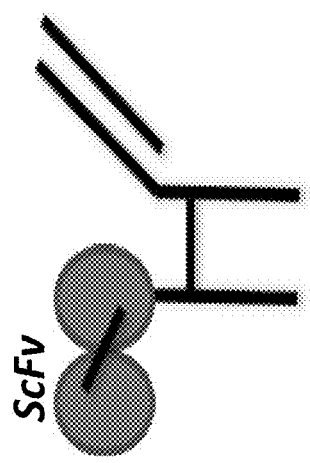
FIGS. 53A-53C show exemplary Fc-based bi-specific constructs.
Figure 53B:
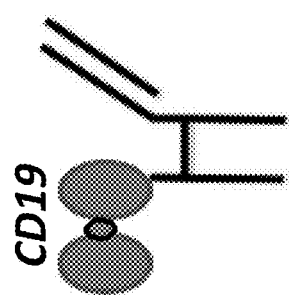
Figure 53C:
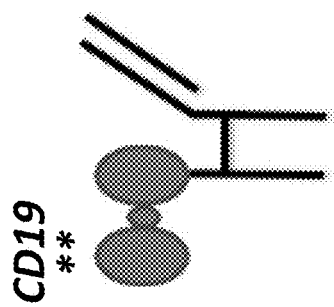

In some embodiments, an Fc-based construct is or includes a bispecific antibody or portion thereof, which binds different targets (e.g., a TSA or TAA described herein). Various bispecific antibodies are known in the art (see, e.g., Kontermann et al., Drug Disc. Today 20:838-847 (2015); Spiess et al., Mol. Immunol. 67:95-106 (2015)), and can be used in a construct described herein. Exemplary bispecific antibodies include, e.g., triomab, knobs into holes (kih) IgG, crossMab, ortho-Fab IgG, dual variable domain immunoglobulins (DVD-Ig), 2 in 1-IgG, IgG-scFv, tandem scFv, scFv$_2$-Fc, bi-nanobody, BiTE, tandAbs, DART, DART-Fc, scFv-HAS-scFv, dock-and-lock (DNL)-Fab3, ImmTAC, DAF, HAS body, IgG-fynomer, and ART-Ig. Additional examples include XmAb5574, XmAb5871, XmAb7195, Xtend-TNF, XmAb14045, XmAb13676, XmAb13551 (Xencor). One exemplary construct is depicted in FIG. 53A, which includes heterodimeric heavy chains, and where one arm of the construct includes a VH/VL and the other arm includes an scFv fused to the Fc region. In some embodiments, a construct depicted in FIG. 53A is monovalent, where the VH/VL arm binds a tumor antigen (e.g., a TSA or TAA described herein), and the scFv binds a T cell antigen described herein (e.g., CD3). Another exemplary construct is depicted in FIG. 53B, in which the scFv of the construct depicted in FIG. 53A is replaced with one or two extracellular C2-type Ig domains of CD19. In addition, the construct depicted in FIG. 53B presents CD19 as a target for one or more additional therapeutics described herein (e.g., CART, ADC, etc.). Another exemplary construct is depicted in FIG. 53C, in which one or both extracellular C2-type Ig domains of CD19 are C2-type Ig domain variants described herein (depicted with "**"). In some embodiments, such a construct can be bivalent, in which the VH/VL and C2-type Ig domain variant (or ECD variant) bind the same target (e.g., a TSA or TAA described herein), or can be bispecific, in which the VH/VL and C2-type Ig domain variant (or ECD variant) bind different targets (e.g., a TSA or TAA described herein). In addition, such construct depicted in FIG. 53C presents CD19 as a target for one or more additional therapeutics described herein (e.g., CART, ADC, etc.).

In some embodiments, an Fc-based construct includes an Fc Ig "swap". FIG. 54A schematically depicts an antibody in which each Fc heavy chain includes two Ig constant domains, one called CH2 (blue) and the other called CH3 (red). In some embodiments, an Fc-based construct includes an antibody as depicted in FIG. 54B, which includes one or two heavy chains that include CH2 (blue) fused to one or more extracellular C2-type Ig domains of CD19 described herein, one or more Ig domains of CD22 described herein, and/or one or more Ig domains of CD79a or CD79b described herein (depicted green in FIG. 54B).

Figure 55B:
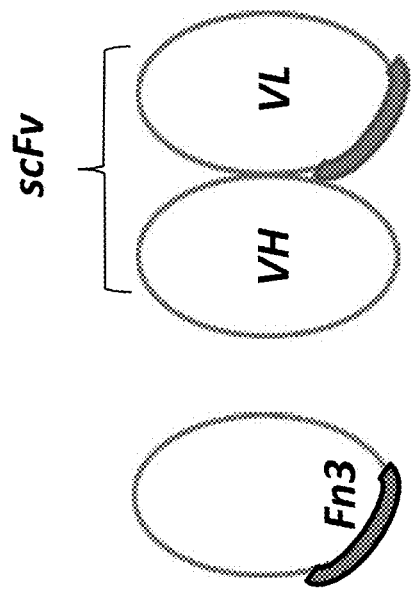
FIGS. 55A and 55B show exemplary constructs in which a loops in one or both Fc CH3 domains is replaced.
Figure 55A:
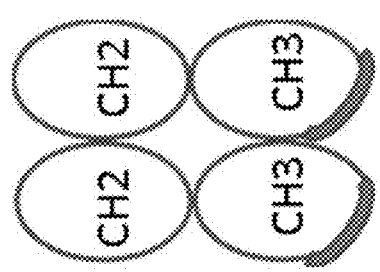

In some embodiments, an Fc-based construct includes a fusion protein (as described herein) and that includes an Ig constant domain, or a Type III fibronectin domain, and one or more "loops" of an extracellular C2-type Ig domains of CD19 described herein. The structure of extracellular C2-type Ig domains of CD19 are known to include three "loops". One exemplary construct is depicted in FIG. 55A, in which a loop in one or both Fc CH3 domains is replaced with a loop of extracellular C2-type Ig domain of CD19. Another exemplary construct is depicted in FIG. 55B, in which 1, 2, or 3 loops of extracellular C2-type Ig domain of CD19 are grafted onto VH, Type III fibronectin domain, or scFv.

In some embodiments, a constitutive expression construct encodes one or more Fc-based constructs described herein. In some embodiments, an inducible expression construct encodes one or more Fc-based constructs described herein. In some embodiments, an Fc-based construct described herein can additionally or alternatively be produced and/or purified using known methods. In some embodiments, such produced and/or purified Fc-based constructs can be used, as described herein, as a protein therapeutic.

11. Expressed Polypeptides with Inducible Function

In some embodiments, an expression construct described herein (e.g., a constitutive expression construct or inducible expression construct) encodes one or more polypeptides, which exhibit one or more inducible functions. In some embodiments, a polypeptide is or comprises, e.g., an antibody or enzyme, of which one or more functions is reversibly reduced, blocked or inhibited, and whose function can be induced, e.g., by unblocking or disinhibition. A variety of polypeptides with inducible function are known in the art and include, e.g., polypeptides that include ligand binding sites (e.g., hormone binding domain inducible function (see, for example, Eilers et al. Nature 340, 66-68 1989) or masked polypeptides (e.g., antibodies, enzymes). In some embodiments, an inducible function is inducible binding of a target antigen (e.g., a TAA or TSA described herein).

Masked Constructs

In some embodiments, an expressed polypeptide is or includes a masked version of an antigen-binding protein described herein (e.g., antibody or antibody fragment described herein, or a scaffold protein described herein (e.g., Type III fibronectin domain, CD19 variant protein, or B cell specific marker variant described herein)). In some embodiments, an expressed polypeptide includes a masked version of an antibody or antibody fragment described herein (e.g., a Probody® as described in, e.g., Sandersjoo et al. Cell. Mol. Life Sci. (2015) 72:1405-1415; US 2015/0183875; U.S. Pat. Nos. 8,513,390; and 9,120,853). In some embodiments, a masked construct comprises an antibody, or fragment thereof, or a scaffold protein described herein (e.g., Type III fibronectin domain, CD19 variant protein, or B cell specific marker variant described herein), a masking moiety, a cleavable moiety, and/or a linker. In some embodiments, a masked construct includes an antigen-binding protein that targets one or more TSA described herein. In some embodiments, a masked construct includes an antigen-binding protein that targets one or more TAA described herein. In some embodiments, a masked construct includes an antigen-binding protein that targets one or more TSA and one or more TAA described herein. In some embodiments, an induced expression construct encodes one or more masked constructs. In some embodiments, a constitutive expression construct encodes one or more masked constructs.

In some embodiments, a masked construct comprises an antigen-binding protein (e.g., antibody, or fragment thereof, or a scaffold protein described herein (e.g., Type III fibronectin domain, CD19 variant protein, or B cell specific marker variant described herein)), and a masking moiety. In some embodiments, a masking moiety is an amino acid sequence coupled to the antigen-binding protein, and positioned such that it reduces the protein's ability to specifically bind its target ("masking" the antigen-binding protein). In some embodiments, a masking moiety is coupled to the antigen-binding protein by way of a linker. In some embodiments, specific binding of a masked antigen-binding protein, to its target is reduced or inhibited, as compared to the specific binding of an "unmasked" antigen-binding protein, or as compared to the specific binding of the parental antigen-binding protein, to the target. In some embodiments, a masked antigen-binding protein demonstrates no measurable binding or substantially no measurable binding to the target, and/or demonstrates no more than 0.001%, 0.01%, 0.1%, 1%, 2%, 3%, 4%, 5%, 6%, 7%, 8%, 9%, 10%, 15%, 20%, 25%, 30%, 35%, 40%, or 50% binding to the target, as compared to the binding of an unmasked antigen-binding protein, or as compared to the binding of the parental antigen-binding protein to the target, e.g., for at least 2, 4, 6, 8, 12, 28, 24, 30, 36, 48, 60, 72, 84, 96 hours, or 5, 10, 15, 30, 45, 60, 90, 120, 150, 180 days, or 1, 2, 3, 4, 5, 6, 7, 8, 9, 10, 11, 12 months or greater, e.g., when measured in vivo or in a Target Displacement in vitro immunoabsorbent assay (described in U.S. Pat. No. 8,513,390).

In some embodiments, specific binding of a masked antigen-binding protein to its target is reduced or inhibited, as compared to specific binding of the unmasked antigen-binding protein, or as compared to the specific binding of the parental antigen-binding protein to the target. The $K_d$ of the masked antigen-binding protein towards the target can be at least 5, 10, 25, 50, 100, 250, 500, 1,000, 2,500, 5,000, 10,000, 50,000, 100,000, 500,000, 1,000,000, 5,000,000, 10,000,000, 50,000,000 or greater, or between 5-10, 10-100, 10-1,000, 10-10,000, 10-100,000, 10-1,000,000, 10-10,000, 000, 100-1,000, 100-10,000, 100-100,000, 100-1,000,000, 100-10,000,000, 1,000-10,000, 1,000-100,000, 1,000-1,000, 000, 1000-10,000,000, 10,000-100,000, 10,000-1,000,000, 10,000-10,000,000, 100,000-1,000,000, or 100,000-10,000, 000 times greater than that of the unmasked antigen-binding protein, or than that of the parental antigen-binding protein. Conversely, the binding affinity of the masked antigen-binding protein towards the target can be at least 5, 10, 25, 50, 100, 250, 500, 1,000, 2,500, 5,000, 10,000, 50,000, 100,000, 500,000, 1,000,000, 5,000,000, 10,000,000, 50,000,000 or greater, or between 5-10, 10-100, 10-1,000, 10-10,000, 10-100,000, 10-1,000,000, 10-10,000,000, 100-1,000, 100-10,000, 100-100,000, 100-1,000,000, 100-10, 000,000, 1,000-10,000, 1,000-100,000, 1,000-1,000,000, 1000-10,000,000, 10,000-100,000, 10,000-1,000,000, 10,000-10,000,000, 100,000-1,000,000, or 100,000-10,000, 000 times lower than that of the unmasked antigen-binding protein, or than that of the parental antigen-binding protein.

Masking moieties are known in the art and include, e.g., known binding partners of antibodies, or fragments thereof. In some embodiments, a masking moiety is an amino acid sequence at the N-terminus, at the C-terminus, and/or within an internal site (e.g., an antigen binding loop) of the antigen-binding protein. In some embodiments, a masking moiety is or includes one or more pairs of cysteine residues, e.g., resulting in formation of a disulfide bond between cysteine pairs. In some such embodiments, disulfide bonds result in a conformationally constrained structure, which can be "unmasked" by cleavage of the disulfide bond by, e.g., a reducing agent. Exemplary masking moieties are described in, e.g., Sandersjoo et al. Cell. Mol. Life Sci. (2015) 72:1405-1415; US 2015/0183875; U.S. Pat. Nos. 8,513,390; and 9,120,853.

In some embodiments, an expressed polypeptide is an antibody fusion protein described herein that includes a masking moiety, e.g., a masked scFv-CD19 or masked CD19-scFv fusion protein described herein. In some embodiments, a masked scFv-CD19 fusion protein includes a masking moiety at the N-terminus of the fusion protein. In some embodiments, a masked scFv-CD19 fusion protein includes a masking moiety at the C-terminus of the fusion protein. In some embodiments, a masked CD19-scFv fusion protein includes a masking moiety at the N-terminus of the fusion protein. In some embodiments, a masked CD19-scFv fusion protein includes a masking moiety at the C-terminus of the fusion protein.

In some embodiments, an expressed polypeptide is a masked fusion protein that includes an scFv described herein at the N-terminus and a fragment of CD19 at the C-terminus (an scFv-CD19 fragment fusion protein), or a masked fusion protein that includes a fragment of CD19 at the N-terminus and an scFv described herein at the C-terminus (a CD19 fragment-scFv fusion protein). In some embodiments, a masked scFv-CD19 fragment fusion protein includes a masking moiety at the N-terminus of the fusion protein. In some embodiments, a masked scFv-CD19 fragment fusion protein includes a masking moiety at the C-terminus of the fusion protein. In some embodiments, a masked CD19 fragment-scFv fusion protein includes a masking moiety at the N-terminus of the fusion protein. In some embodiments, a masked CD19 fragment-scFv fusion protein includes a masking moiety at the C-terminus of the fusion protein.

In some embodiments, an expressed polypeptide is or includes a masked antibody (or fragment thereof) known in the art, including but not limited to, a masked version of cetuximab, panitumumab, infliximab, adalimumab, efalizumab, ipilimumab, tremelimumab, adecatumumab, Hu5c8, alemtuzumab, ranibizumab, tositumomab, ibritumomab tiuxetan, rituximab, infliximab, bevacizumab, or figitumumab, or a fragment thereof (e.g., a masked scFv fragment). Additional antibodies that can be masked are described in, e.g., U.S. Pat. Nos. 8,513,390, 9,120,853, 9,127,053, US 20150183875, US 20140363430, US 20140045195, US20130101555, and US 20100189651.

In some embodiments, a masked antibody or fusion protein additionally includes one or more cleavable moieties. In some embodiments, a cleavable moiety is or includes, e.g., one or more amino acid sequences that can serve as a substrate for one or more proteases, such as one or more extracellular proteases. In some embodiments, a cleavable moiety is or includes a cysteine-cysteine pair capable of forming a disulfide bond, which can be cleaved by action of a reducing agent. In other embodiments, a cleavable moiety is or includes a substrate capable of being cleaved upon photolysis.

In some embodiments, a cleavable moiety is selected based on presence of a protease in or in proximity to tissue with a desired target of an antibody, or fragment thereof. In some embodiments, target tissue is a cancerous tissue. Proteases having substrates in a number of cancers, e.g., solid tumors, are known in the art (see, e.g., La Rocca et al, (2004) British J. of Cancer 90(7): 1414-1421). In some embodiments, a cleavable moiety is or includes a target for, e.g., legumain, plasmin, TMPRSS-3/4, MMP-9, MT1-MMP, ADAM (a disintegrin and metalloproteinase, e.g., ADAMs1-20, e.g., ADAM8, ADAM10, ADAM17), cathepsin (e.g., cathepsin A, B, C, D, E, F, G, H, L, K, O, S, V, or W (Tan et al., World J. Biol. Chem. 4:91-101 (2013)), caspase, human neutrophil elastase, beta-secretase, matriptase, uPA, or PSA.

In some embodiments, a masked construct described herein includes a linker, e.g., C-terminal and/or N-terminal to a masking moiety and/or cleavage moiety. In some embodiments, a linker may provide flexibility for the masking moiety to reversibly inhibit binding of the antigen-binding protein to its target. Suitable linkers can be readily selected and can be of any of a suitable of different lengths, such as from 1 amino acid (e.g., Gly) to 20 amino acids, from 2 amino acids to 15 amino acids, from 3 amino acids to 12 amino acids, including 4 amino acids to 10 amino acids, 5 amino acids to 9 amino acids, 6 amino acids to 8 amino acids, or 7 amino acids to 8 amino acids, and may be 1, 2, 3, 4, 5, 6, or 7 amino acids. In some embodiments, a masking moiety is fused to an antigen-binding protein through a polypeptide linker. In some embodiments, a linker used to fuse a masking moiety to an antigen-binding protein is a cleavable moiety described herein. In some embodiments a masking moiety is fused, directly or by linker, to the N-terminus of an antigen-binding protein. In some embodiments a masking moiety is fused, directly or by linker, to the C-terminus of an antigen-binding protein.

Figure 56:
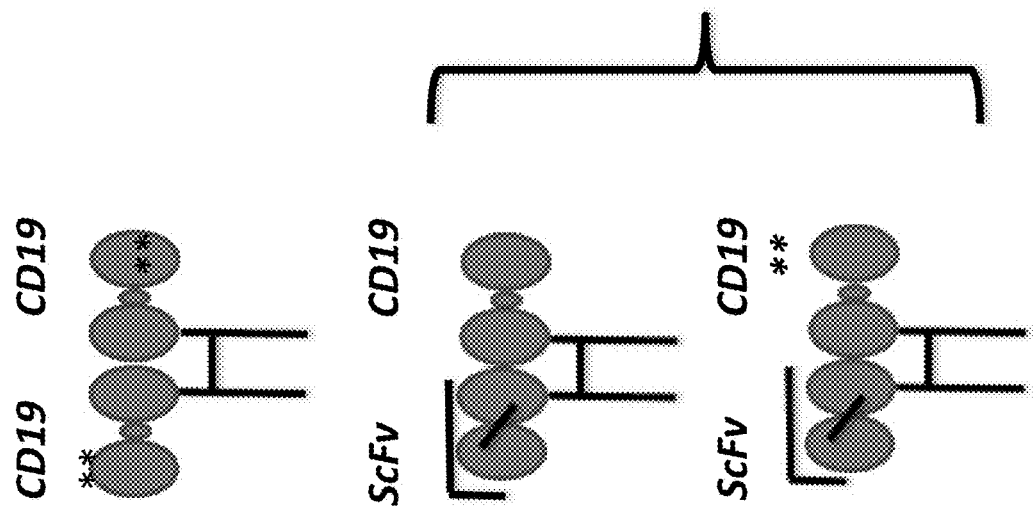
FIG. 56 shows an exemplary construct with fusion of a masking moiety to constructs described in FIGS. 52B and 52C with a masking moiety fused to the N-terminus of the scFv.
Figure 57:
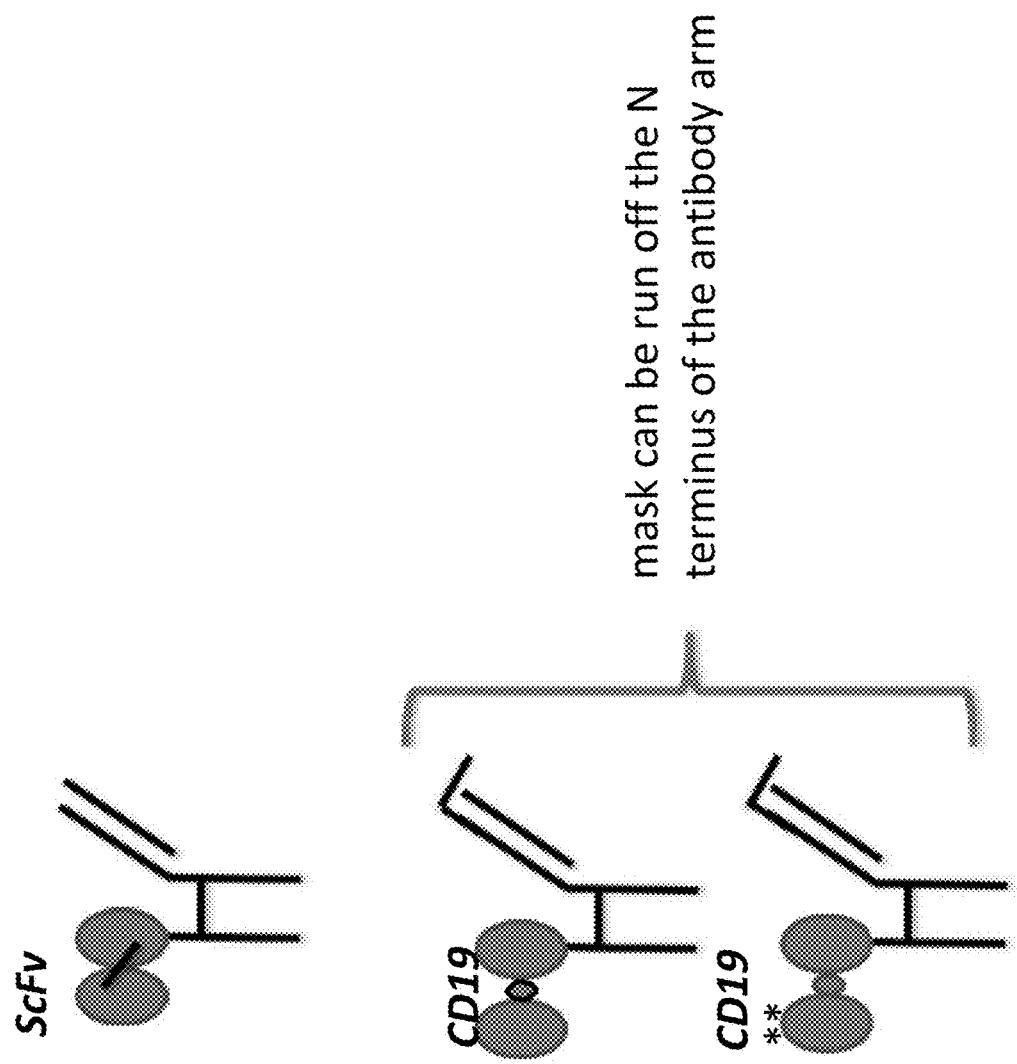
FIG. 57 shows an exemplary construct with fusion of a masking moiety to constructs described in FIGS. 53B and 53C with the masking moiety fused to the N-terminus of the VH and/or VL on the VH/VL arm.
Figure 58:
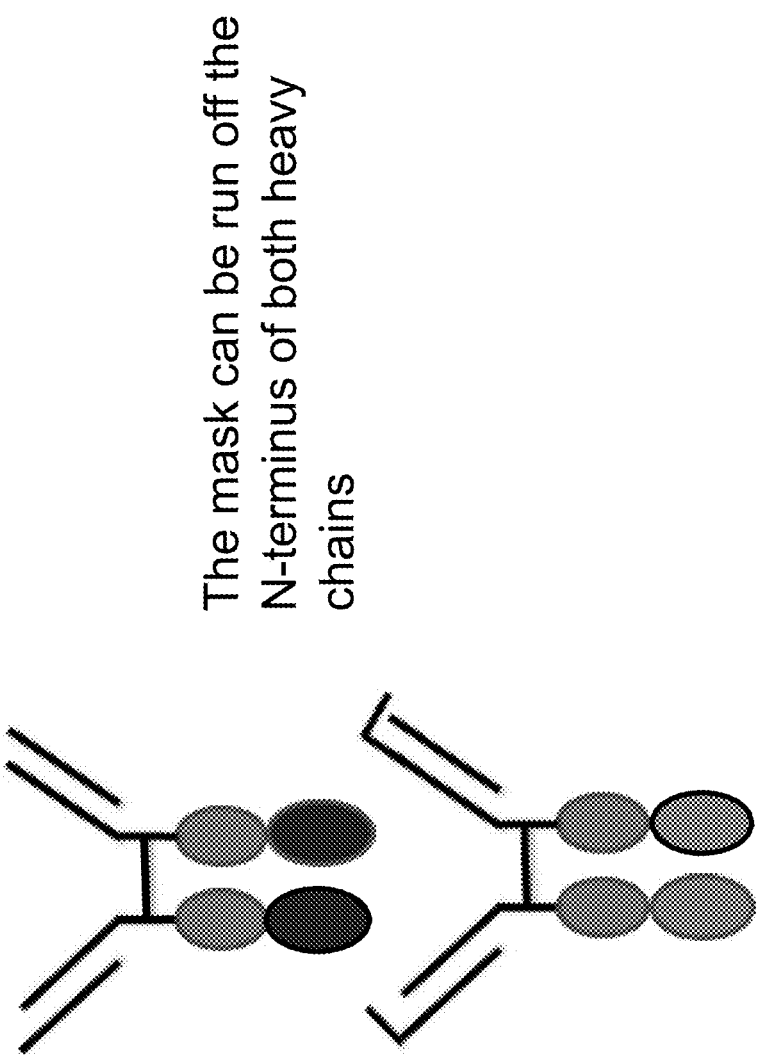
FIG. 58 shows an exemplary construct with fusion of a masking moiety to construct described in FIG. 54B with a masking moiety fused to the N-terminus of each heavy chain.
Figure 59:
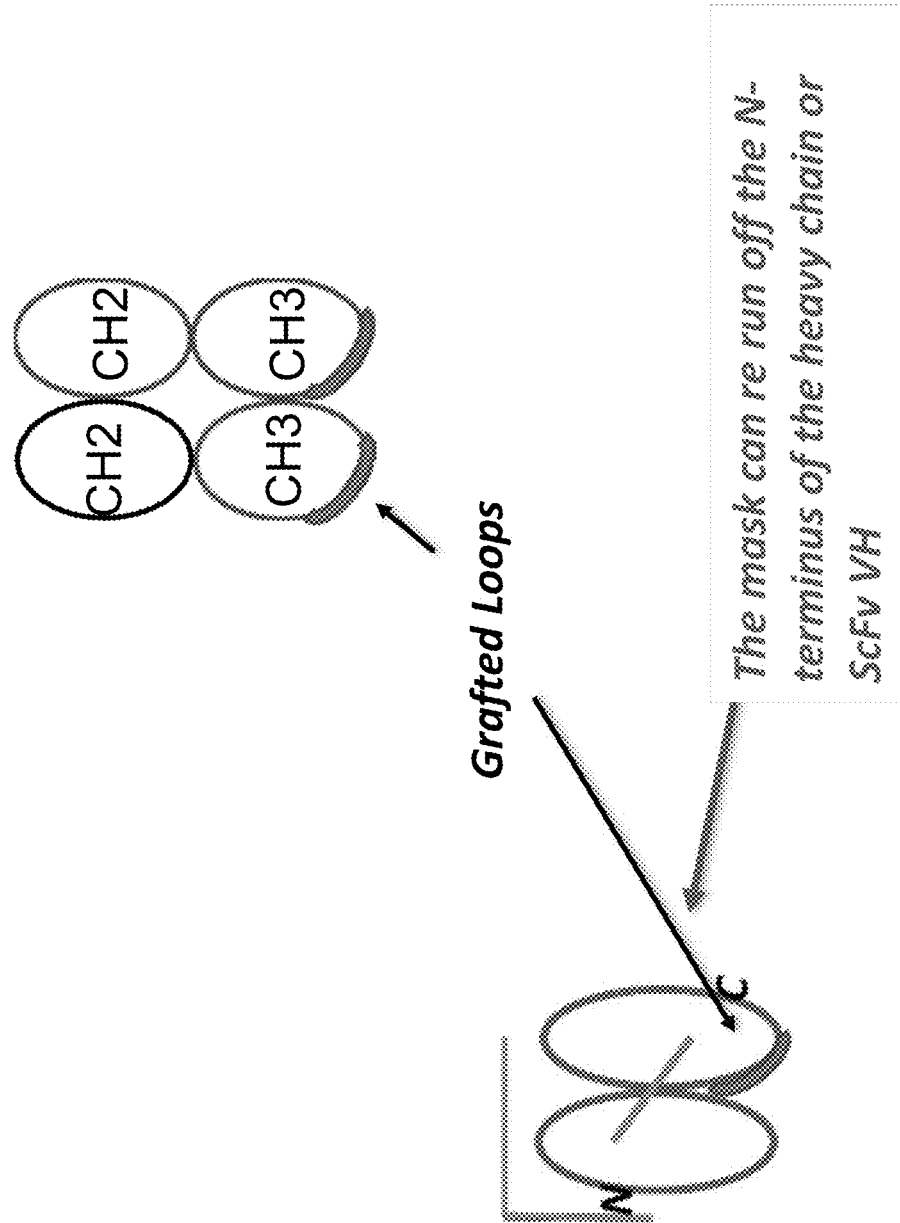
FIG. 59 shows an exemplary construct with fusion of a masking moiety to constructs described in FIGS. 55A and 55B with a masking moiety fused to the N-terminus of a heavy chain and/or scFv VH.

A masked construct can include any expressed polypeptide described herein. One set of exemplary masked constructs is depicted in FIG. 56, which shows fusion of a masking moiety to constructs described in FIGS. 52B and 52C. In some embodiments, as depicted in FIG. 56, a masking moiety can be fused to the N-terminus of the scFv. Another exemplary set of masked constructs is depicted in FIG. 57, which shows fusion of a masking moiety to constructs described in FIGS. 53B and 53C. In some embodiments, as depicted in FIG. 57, a masking moiety can be fused to the N-terminus of the VH and/or VL on the VH/VL arm. Another exemplary set of masked constructs is depicted in FIG. 58, which shows fusion of a masking moiety to construct described in FIG. 54B. In some embodiments, as depicted in FIG. 58, a masking moiety can be fused to the N-terminus of each heavy chain, which each includes CH2 (blue) fused to one or more extracellular C2-type Ig domains of CD19 described herein, one or more Ig domains of CD22 described herein, and/or an Ig domain of CD79a or CD79b described herein (depicted green). In some embodiments, a masking moiety can be fused to the N-terminus of one or both heavy chains. Additionally or alternatively, in some embodiments, a masking moiety can be fused to the N-terminus of one or both light chains. An additional exemplary masked construct is depicted in FIG. 59, which shows fusion of a masking moiety to constructs described in FIGS. 55A and 55B. In some embodiments, as depicted in FIG. 59, a masking moiety can be fused to the N-terminus of a heavy chain and/or scFv VH.

In some embodiments, a constitutive expression construct encodes one or more masked constructs described herein. In some embodiments, an inducible expression construct encodes one or more masked constructs described herein.

In some embodiments, a constitutive expression construct encodes a masked construct described herein (e.g., a masked construct depicted in FIG. 56, 57, 58, or 59). In some embodiments, a constitutive expression construct encodes a masked fusion protein or masked Fc-based construct described herein that includes an antigen-binding protein (that targets a TSA or TAA) fused to a target for a CART cell, an ADC, etc., described herein. In some embodiments, a constitutive expression construct encodes a masked fusion protein or masked Fc-based construct described herein that includes an antigen-binding protein (that targets a TSA or TAA) fused to a B cell antigen or portion described herein. In some embodiments, a constitutive expression construct encodes a fusion protein that includes a masked anti-TAA and/or anti-TSA antibody (or portion thereof) and CD19 or fragment. A masked antigen-binding protein (when unmasked) can bind to any known TAA and/or TSA, e.g., any TAA and/or TSA described herein.

In some embodiments, a masked construct described herein can additionally or alternatively be produced and/or purified using known methods. In some embodiments, such produced and/or purified masked construct can be used, as described herein, as a protein therapeutic.

Methods of Producing Cellular Therapeutics

In general, a cellular therapeutic described herein can be produced from an immune cell, e.g., a cell useful in or capable of use in adoptive cell therapy. In some embodiments, a cellular therapeutic is produced from a cell type selected from a group consisting of TILs, T-cells, CD8$^+$ cells, CD4$^+$ cells, NK-cells, delta-gamma T-cells, regulatory T-cells or peripheral blood mononuclear cells. As used herein "tumor-infiltrating lymphocytes" or TILs refer to white blood cells that have left the bloodstream and migrated into a tumor. Lymphocytes can be divided into three groups including B cells, T cells and natural killer cells. As used herein "T-cells" refers to CD3$^+$ cells, including CD4$^+$ helper cells, CD8$^+$ cytotoxic T-cells and delta-gamma T cells.

In certain embodiments a cellular therapeutic is produced by genetically modifying (e.g., transforming) a cell, e.g., an immune cell, with a nucleic acid encoding an antigen binding receptor and/or an expression construct described herein (e.g., (i) a first recombinant expression vector that includes a nucleic acid encoding an antigen binding receptor and a second recombinant expression vector that includes an inducible expression construct, (ii) a single recombinant expression vector that includes both a nucleic acid encoding an antigen binding receptor and an inducible expression construct; or (iii) a recombinant expression vector that includes a constitutive expression construct). The recombinant expression vector can comprise any type of nucleotides, including, but not limited to DNA and RNA, which can be single-stranded or double-stranded, synthesized or obtained in part from natural sources, and which can contain natural, non-natural or altered nucleotides. A recombinant expression vector can comprise naturally-occurring or non-naturally-occurring internucleotide linkages, or both types of linkages.

A recombinant expression vector can be any suitable recombinant expression vector. Suitable vectors include those designed for propagation and expansion or for expression or both, such as plasmids and viruses. For example, a vector can be selected from the pUC series (Fermentas Life Sciences, Glen Burnie, Md.), the pBluescript series (Stratagene, LaJolla, Calif.), the pET series (Novagen, Madison, Wis.), the pGEX series (Pharmacia Biotech, Uppsala, Sweden), and the pEX series (Clontech, Palo Alto, Calif.). Bacteriophage vectors, such as λGT10, λGT11, λZapII (Stratagene), λEMBL4, and λNM1149, also can be used. Examples of plant expression vectors useful in the context of the disclosure include pBI01, pBI101.2, pBI101.3, pBI121 and pBIN19 (Clontech). Examples of animal expression vectors useful in the context of the disclosure include pcDNA, pEUK-Cl, pMAM, and pMAMneo (Clontech). In some embodiments, a bicistronic IRES vector (e.g., from Clontech) is used to include both a nucleic acid encoding an antigen binding receptor and an inducible expression construct described herein.

In some embodiments, a recombinant expression vector is a viral vector. Suitable viral vectors include, without limitation, retroviral vectors, alphaviral, vaccinial, adenoviral, adeno-associated viral, herpes viral, and fowl pox viral vectors, and preferably have a native or engineered capacity to transform an immune cell (e.g., T cell).

Recombinant expression vectors can be prepared using standard recombinant DNA techniques described in, for example, Sambrook et al., Molecular Cloning: A Laboratory Manual, 3rd ed., Cold Spring Harbor Press, Cold Spring Harbor, N.Y. 2001; and Ausubel et al., Current Protocols in Molecular Biology, Greene Publishing Associates and John Wiley & Sons, N Y, 1994. Constructs of expression vectors, which are circular or linear, can be prepared to contain a replication system functional in a prokaryotic or eukaryotic host cell. Replication systems can be derived, e.g., from ColEl, 2μ plasmid, λ, SV40, bovine papilloma virus, and the like.

A recombinant expression vector can include one or more marker genes, which allow for selection of transformed or transfected hosts. Marker genes include biocide resistance, e.g., resistance to antibiotics, heavy metals, etc., complementation in an auxotrophic host to provide prototrophy, and the like. Suitable marker genes for the recombinant expression vectors include, for instance, neomycin/G418 resistance genes, puromycin resistance genes, hygromycin resistance genes, histidinol resistance genes, tetracycline resistance genes, and ampicillin resistance genes.

Vectors useful in the context of the disclosure can be "naked" nucleic acid vectors (i.e., vectors having little or no proteins, sugars, and/or lipids encapsulating them), or vectors complexed with other molecules. Other molecules that can be suitably combined with the vectors include without limitation viral coats, cationic lipids, liposomes, polyamines, gold particles, and targeting moieties such as ligands, receptors, or antibodies that target cellular molecules.

Vector DNA can be introduced into a cell, e.g., an immune cell, via conventional transformation or transfection techniques. As used herein, the terms "transformation" and "transfection" are intended to refer to a variety of art-recognized techniques for introducing foreign nucleic acid (e.g., DNA) into a cell, including calcium phosphate or calcium chloride co-precipitation, DEAE-dextran-mediated transfection, lipofection, gene gun, or electroporation.

Protein Therapeutics

In some aspects, polypeptides encoded by genes that can be included in an expression construct described herein can be produced and used as therapeutics instead of, or in addition to, being produced by a cellular therapeutic described herein. Such polypeptides can be included in a composition, e.g., a pharmaceutical composition, and used as a protein therapeutic. For example, a protein therapeutic that includes a polypeptide that is or comprises a target for a cellular therapeutic, e.g., a CAR-T cell or ADC, can be administered in combination with such cellular therapeutic, e.g., CAR-T cell or ADC.

In one example, a protein therapeutic includes an antibody fusion protein that contains an antigen binding fragment of an antibody (e.g., one or more of the types described herein) that binds to an antigen (e.g., one or more of the types described herein). In another example, an antibody fusion protein includes a bispecific antibody (or fragment) that binds two antigens. In some embodiments, such a bispecific antibody binds one or more TAA and/or TSA targets, e.g., that together define a specific tumor type. Examples of such combinations of TAA and/or TSA targets that allow for the specific recognition of a tumor type include, e.g., CD70 and carbonic anhydrase IX (renal cell carcinoma), MUC16 and mesothelin (ovarian cancer), and many others. Such antigen binding fragments (e.g., bispecific) are in turn fused to a polypeptide antigen recognized by a cellular therapeutic, e.g. a CAR T cell. One exemplary polypeptide antigen is an Ig domain of CD19 that is recognized by CAR-CD19 T cells. The modular characteristics of antibody antigen recognition domains allow consideration of many combinations of antigen recognition domains fused to target polypeptides for a cellular therapeutic.

In some embodiments, a polypeptide antigen, e.g., one recognized by a cellular therapeutic, is fused to the amino (N) terminus of an antigen binding fragment. In some embodiments, a polypeptide antigen is fused to the carboxy (C) terminus of an antigen binding fragment. In particular embodiments, a protein therapeutic is or includes an Fc-based construct described herein.

A variety of methods of making polypeptides are known in the art and can be used to make a polypeptide to be included in a protein therapeutic. For example, a polypeptide can be recombinantly produced by utilizing a host cell system engineered to express a nucleic acid encoding the polypeptide. Recombinant expression of a gene can include construction of an expression vector containing a polynucleotide that encodes the polypeptide. Once a polynucleotide has been obtained, a vector for the production of the polypeptide can be produced by recombinant DNA technology using techniques known in the art. Known methods can be used to construct expression vectors containing polypeptide coding sequences and appropriate transcriptional and translational control signals. These methods include, for example, in vitro recombinant DNA techniques, synthetic techniques, and in vivo genetic recombination.

An expression vector can be transferred to a host cell by conventional techniques, and transfected cells can then be cultured by conventional techniques to produce polypeptide. A variety of host expression vector systems can be used (see, e.g., U.S. Pat. No. 5,807,715). Such host-expression systems can be used to produce polypeptides and, where desired, subsequently purified. Such host expression systems include microorganisms such as bacteria (e.g., *E. coli* and *B. subtilis*) transformed with recombinant bacteriophage DNA, plasmid DNA or cosmid DNA expression vectors containing polypeptide coding sequences; yeast (e.g., *Saccharomyces* and *Pichia*) transformed with recombinant yeast expression vectors containing polypeptide coding sequences; insect cell systems infected with recombinant virus expression vectors (e.g., baculovirus) containing polypeptide coding sequences; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing polypeptide coding sequences; or mammalian cell systems (e.g., COS, CHO, BHK, 293, NSO, and 3T3 cells) harboring recombinant expression constructs containing promoters derived from the genome of mammalian cells (e.g., metallothionein promoter) or from mammalian viruses (e.g., the adenovirus late promoter; the vaccinia virus 7.5K promoter).

For bacterial systems, a number of expression vectors can be used, including, but not limited to, the *E. coli* expression vector pUR278 (Ruther et al., 1983, EMBO 12:1791); pIN vectors (Inouye & Inouye, 1985, Nucleic Acids Res. 13:3101-3109; Van Heeke & Schuster, 1989, J. Biol. Chem. 24:5503-5509); and the like. pGEX vectors can also be used to express foreign polypeptides as fusion proteins with glutathione 5-transferase (GST).

For expression in mammalian host cells, viral-based expression systems can be utilized (see, e.g., Logan & Shenk, 1984, Proc. Natl. Acad. Sci. USA 8 1:355-359). The efficiency of expression can be enhanced by inclusion of appropriate transcription enhancer elements, transcription terminators, etc. (see, e.g., Bittner et al., 1987, Methods in Enzymol. 153:516-544).

In addition, a host cell strain can be chosen that modulates expression of inserted sequences, or modifies and processes the gene product in the specific fashion desired. Different host cells have characteristic and specific mechanisms for post-translational processing and modification of proteins and gene products. Appropriate cell lines or host systems can be chosen to ensure the correct modification and processing of the polypeptide expressed. Such cells include, for example, established mammalian cell lines and insect cell lines, animal cells, fungal cells, and yeast cells. Mammalian host cells include, e.g., BALB/c mouse myeloma line (NSO/l, ECACC No: 85110503); human retinoblasts (PER.C6, CruCell, Leiden, The Netherlands); monkey kidney CV1 line transformed by SV40 (COS-7, ATCC CRL 1651); human embryonic kidney line (293 or 293 cells subcloned for growth in suspension culture, Graham et al., J. Gen Virol., 36:59, 1977); human fibrosarcoma cell line (e.g., HT1080); baby hamster kidney cells (BHK, ATCC CCL 10); Chinese hamster ovary cells+/−DHFR (CHO, Urlaub and Chasin, Proc. Natl. Acad. Sci. USA, 77:4216, 1980); mouse sertoli cells (TM4, Mather, Biol. Reprod., 23:243-251, 1980); monkey kidney cells (CV1 ATCC CCL 70); African green monkey kidney cells (VERO-76, ATCC CRL-1 587); human cervical carcinoma cells (HeLa, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor (MMT 060562, ATCC CCL51); TM cells (Mather et al., Annals N.Y. Acad. Sci., 383:44-68, 1982); MRC 5 cells; FS4 cells; and a human hepatoma line (Hep G2).

For long-term, high-yield production of recombinant proteins, host cells are engineered to stably express a polypeptide. Host cells can be transformed with DNA controlled by appropriate expression control elements known in the art, including promoter, enhancer, sequences, transcription terminators, polyadenylation sites, and selectable markers. Methods commonly known in the art of recombinant DNA technology can be used to select a desired recombinant clone.

Once a protein described herein has been produced by recombinant expression, it may be purified by any method known in the art for purification, for example, by chromatography (e.g., ion exchange, affinity, and sizing column chromatography), centrifugation, differential solubility, or by any other standard technique for purification of proteins.

For example, an antibody can be isolated and purified by appropriately selecting and combining affinity columns such as Protein A column with chromatography columns, filtration, ultra filtration, salting-out and dialysis procedures (see Antibodies: A Laboratory Manual, Ed Harlow, David Lane, Cold Spring Harbor Laboratory, 1988). Further, as described herein, a polypeptide can be fused to heterologous polypeptide sequences to facilitate purification. Alternatively or additionally, a polypeptide can be partially or fully prepared by chemical synthesis. Alternatively or additionally, a polypeptide can be purified from natural sources.

Administration

Certain embodiments of the disclosure include methods of administering to a subject a cellular therapeutic described herein (or a population thereof), a protein therapeutic described herein, a composition comprising a cellular therapeutic, and/or a composition comprising a protein therapeutic, e.g., in an amount effective to treat a subject. In some embodiments, the method effectively treats cancer in the subject.

In some embodiments, an immune cell is obtained from a subject and is transformed, e.g., transduced, with inducible expression construct or a constitutive expression construct described herein, e.g., an expression vector comprising an inducible expression construct or a constitutive expression construct described herein, to obtain a cellular therapeutic. Thus, in some embodiments, a cellular therapeutic comprises an autologous cell that is administered into the same subject from which an immune cell was obtained. Alternatively, an immune cell is obtained from a subject and is transformed, e.g., transduced, with an inducible expression construct or a constitutive expression construct described herein, e.g., an expression vector comprising an inducible expression construct or a constitutive expression construct described herein, to obtain a cellular therapeutic that is allogenically transferred into another subject.

In some embodiments, a cellular therapeutic is autologous to a subject, and the subject can be immunologically naive, immunized, diseased, or in another condition prior to isolation of an immune cell from the subject.

In some embodiments, additional steps can be performed prior to administration to a subject. For instance, a cellular therapeutic can be expanded in vitro after contacting (e.g., transducing or transfecting) an immune cell with an inducible expression construct or a constitutive expression construct described herein (e.g., an expression vector comprising an inducible expression construct or a constitutive expression construct), but prior to the administration to a subject. In vitro expansion can proceed for 1 day or more, e.g., 2 days or more, 3 days or more, 4 days or more, 6 days or more, or 8 days or more, prior to the administration to a subject. Alternatively, or in addition, in vitro expansion can proceed for 21 days or less, e.g., 18 days or less, 16 days or less, 14 days or less, 10 days or less, 7 days or less, or 5 days or less, prior to administration to a subject. For example, in vitro expansion can proceed for 1-7 days, 2-10 days, 3-5 days, or 8-14 days prior to the administration to a subject.

In some embodiments, during in vitro expansion, a cellular therapeutic can be stimulated with an antigen (e.g., a TCR antigen). Antigen specific expansion optionally can be supplemented with expansion under conditions that non-specifically stimulate lymphocyte proliferation such as, for example, anti-CD3 antibody, anti-Tac antibody, anti-CD28 antibody, or phytohemagglutinin (PHA). The expanded cellular therapeutic can be directly administered into a subject or can be frozen for future use, i.e., for subsequent administrations to a subject.

In some embodiments, a cellular therapeutic is treated ex vivo with interleukin-2 (IL-2) prior to infusion into a cancer patient, and the cancer patient is treated with IL-2 after infusion. Furthermore, in some embodiments, a cancer patient can undergo preparative lymphodepletion—the temporary ablation of the immune system—prior to administration of a cellular therapeutic. A combination of IL-2 treatment and preparative lymphodepletion can enhance persistence of a cellular therapeutic.

In some embodiments, a cellular therapeutic is transduced or transfected with a nucleic acid encoding a cytokine, which nucleic acid can be engineered to provide for constitutive, regulatable, or temporally-controlled expression of the cytokine. Suitable cytokines include, for example, cytokines which act to enhance the survival of T lymphocytes during the contraction phase, which can facilitate the formation and survival of memory T lymphocytes.

In certain embodiments, a cellular therapeutic is administered prior to, substantially simultaneously with, or after the administration of another therapeutic agent, such as a cancer therapeutic agent. The cancer therapeutic agent can be, e.g., a chemotherapeutic agent, a biological agent, or radiation treatment. In some embodiments, a subject receiving a cellular therapeutic is not administered a treatment which is sufficient to cause a depletion of immune cells, such as lymphodepleting chemotherapy or radiation therapy.

A cellular therapeutic described herein can be formed as a composition, e.g., a cellular therapeutic and a pharmaceutically acceptable carrier. In certain embodiments, a composition is a pharmaceutical composition comprising at least one cellular therapeutic described herein and a pharmaceutically acceptable carrier, diluent, and/or excipient. Pharmaceutically acceptable carriers described herein, for example, vehicles, adjuvants, excipients, and diluents, are well-known and readily available to those skilled in the art. Preferably, the pharmaceutically acceptable carrier is chemically inert to the active agent(s), e.g., a cellular therapeutic, and does not elicit any detrimental side effects or toxicity under the conditions of use.

A composition can be formulated for administration by any suitable route, such as, for example, intravenous, intratumoral, intraarterial, intramuscular, intraperitoneal, intrathecal, epidural, and/or subcutaneous administration routes. Preferably, the composition is formulated for a parenteral route of administration.

A composition suitable for parenteral administration can be an aqueous or nonaqueous, isotonic sterile injection solution, which can contain anti-oxidants, buffers, bacteriostats, and solutes, for example, that render the composition isotonic with the blood of the intended recipient. An aqueous or nonaqueous sterile suspension can contain one or more suspending agents, solubilizers, thickening agents, stabilizers, and preservatives.

Dosage administered to a subject, particularly a human, will vary with the particular embodiment, the composition employed, the method of administration, and the particular site and subject being treated. However, a dose should be sufficient to provide a therapeutic response. A clinician skilled in the art can determine the therapeutically effective amount of a composition to be administered to a human or other subject in order to treat or prevent a particular medical condition. The precise amount of the composition required to be therapeutically effective will depend upon numerous factors, e.g., such as the specific activity of the cellular therapeutic, and the route of administration, in addition to many subject-specific considerations, which are within those of skill in the art.

Any suitable number cellular therapeutic cells can be administered to a subject. While a single cellular therapeutic cell described herein is capable of expanding and providing a therapeutic benefit, in some embodiments, $10^2$ or more, e.g., $10^3$ or more, $10^4$ or more, $10^5$ or more, or $10^8$ or more, cellular therapeutic cells are administered. Alternatively, or additionally $10^{12}$ or less, e.g., $10^{11}$ or less, $10^9$ or less, $10^7$ or less, or $10^5$ or less, cellular therapeutic cells described herein are administered to a subject. In some embodiments, $10^2$-$10^5$, $10^4$-$10^7$, $10^3$-$10^9$, or $10^5$-$10^{10}$ cellular therapeutic cells described herein are administered.

A dose of a cellular therapeutic described herein can be administered to a mammal at one time or in a series of subdoses administered over a suitable period of time, e.g., on a daily, semi-weekly, weekly, bi-weekly, semi-monthly, bi-monthly, semi-annual, or annual basis, as needed. A dosage unit comprising an effective amount of a cellular therapeutic may be administered in a single daily dose, or the total daily dosage may be administered in two, three, four, or more divided doses administered daily, as needed.

A polypeptide described herein can be incorporated into a pharmaceutical composition (e.g., for use as a protein therapeutic). Pharmaceutical compositions comprising a polypeptide can be formulated by methods known to those skilled in the art (see, e.g., Remington's Pharmaceutical Sciences pp. 1447-1676 (Alfonso R. Gennaro, ed., 19th ed. 1995)). Pharmaceutical composition can be administered parenterally in the form of an injectable formulation comprising a sterile solution or suspension in water or another pharmaceutically acceptable liquid. For example, a pharmaceutical composition can be formulated by suitably combining a polypeptide with pharmaceutically acceptable vehicles or media, such as sterile water and physiological saline, vegetable oil, emulsifier, suspension agent, surfactant, stabilizer, flavoring excipient, diluent, vehicle, preservative, binder, followed by mixing in a unit dose form required for generally accepted pharmaceutical practices. The amount of active ingredient included in pharmaceutical preparations is such that a suitable dose within the designated range is provided.

The sterile composition for injection can be formulated in accordance with conventional pharmaceutical practices using distilled water for injection as a vehicle. For example, physiological saline or an isotonic solution containing glucose and other supplements such as D-sorbitol, D-mannose, D-mannitol, and sodium chloride may be used as an aqueous solution for injection, optionally in combination with a suitable solubilizing agent, for example, alcohol such as ethanol and polyalcohol such as propylene glycol or polyethylene glycol, and a nonionic surfactant such as polysorbate 80™, HCO-50 and the like.

Nonlimiting examples of oily liquid include sesame oil and soybean oil, and it may be combined with benzyl benzoate or benzyl alcohol as a solubilizing agent. Other items that may be included are a buffer such as a phosphate buffer, or sodium acetate buffer, a soothing agent such as procaine hydrochloride, a stabilizer such as benzyl alcohol or phenol, and an antioxidant. The formulated injection can be packaged in a suitable ampule.

Route of administration can be parenteral, for example, administration by injection, transnasal administration, transpulmonary administration, or transcutaneous administration. Administration can be systemic or local by intravenous injection, intramuscular injection, intraperitoneal injection, subcutaneous injection.

A suitable means of administration can be selected based on the age and condition of the subject. A single dose of a pharmaceutical composition containing a polypeptide can be selected from a range of 0.001 to 1000 mg/kg of body weight. On the other hand, a dose can be selected in the range of 0.001 to 100000 mg/body weight, but the present disclosure is not limited to such ranges. Dose and method of administration can vary depending on the weight, age, condition, and the like of the subject, and can be suitably selected as needed by those skilled in the art.

Tumors

The present disclosure provides technologies useful in the treatment of any tumor. In some embodiments, a tumor is or comprises a hematologic malignancy, including but not limited to, acute lymphoblastic leukemia, acute myeloid leukemia, chronic lymphocytic leukemia, chronic myelogenous leukemia, hairy cell leukemia, AIDS-related lymphoma, Hodgkin lymphoma, non-Hodgkin lymphoma, Langerhans cell histiocytosis, multiple myeloma, or myeloproliferative neoplasms.

In some embodiments, a tumor is or comprises a solid tumor, including but not limited to breast carcinoma, a squamous cell carcinoma, a colon cancer, a head and neck cancer, ovarian cancer, a lung cancer, mesothelioma, a genitourinary cancer, a rectal cancer, a gastric cancer, or an esophageal cancer.

In some particular embodiments, a tumor is or comprises an advanced tumor, and/or a refractory tumor. In some embodiments, a tumor is characterized as advanced when certain pathologies are observed in a tumor (e.g., in a tissue sample, such as a biopsy sample, obtained from a tumor) and/or when cancer patients with such tumors are typically considered not to be candidates for conventional chemotherapy. In some embodiments, pathologies characterizing tumors as advanced can include tumor size, altered expression of genetic markers, invasion of adjacent organs and/or lymph nodes by tumor cells. In some embodiments, a tumor is characterized as refractory when patients having such a tumor are resistant to one or more known therapeutic modalities (e.g., one or more conventional chemotherapy regimens) and/or when a particular patient has demonstrated resistance (e.g., lack of responsiveness) to one or more such known therapeutic modalities.

Melanoma

Melanoma is the fifth most common type of new cancer diagnosis in American men and the seventh most common type in American women. The incidence and mortality rates for invasive melanoma are highest in whites, who have a much higher risk of developing melanoma than African Americans. Among people younger than 45 years, incidence rates are higher in women than in men. By age 60 years, melanoma incidence rates in men are more than twice those of women; by age 80 years, men are nearly three times more likely to develop melanoma than women. The annual incidence rate of melanoma among whites increased by more than 60 percent from 1991 to 2011. The incidence of melanoma has been increasing more rapidly among whites aged 65 and older than among any other group.

Risk factors for melanoma include having fair skin that burns easily, high lifetime exposure to natural or artificial sunlight, a history of blistering sunburns (particularly at a young age), many common moles, a personal or family history of dysplastic nevi or melanoma, and being white. Standard treatments for melanoma include surgery, chemotherapy, radiation therapy, targeted therapy, and biological therapy.

Lung Cancer

Lung cancer is the second most common cancer and the primary cause of cancer-related death in both men and women in the United States. The overall mortality rate for lung and bronchus cancers rose steadily through the 1980s, peaked in the early 1990s, and has been slowly declining since 2001. Trends in lung cancer incidence and mortality rates have closely mirrored historical patterns of smoking prevalence, after accounting for a lag period. Because the prevalence of smoking peaked later in women than in men, lung cancer incidence and mortality rates began declining later for women than men. The incidence rate has been declining since the mid-1980s in men but only since the mid-2000s in women; the mortality rate began declining in 1991 in men and but not until 2003 in women. Incidence and mortality rates are highest among African American men, followed by white men.

Although smoking is the main cause of lung cancer, lung cancer risk also is increased by exposure to secondhand smoke; environmental exposures, such as radon, workplace toxins (e.g., asbestos, arsenic), and air pollution. Standard treatments for lung cancer include surgery, radiation therapy, chemotherapy, targeted therapy, laser therapy, photodynamic therapy, cryosurgery, endoscopic stent placement, and electrocautery.

Head and Neck Cancer

Head and neck cancers, which include cancers of the oral cavity, larynx, pharynx, salivary glands, and nose/nasal passages, account for approximately three percent of all malignancies in the United States. Alcohol and tobacco are the two most prominent risk factors for head and neck cancers with at least 75 percent of head and neck cancers caused by alcohol and tobacco use. Other risk factors can include infection with human papillomavirus especially HPV-16; consumption of Pann (betel quid), Mate and certain preserved or salted foods; poor oral health, occupational or radiation exposure; Epstein-Barr virus infection; and ancestry.

Colorectal Cancer

Colorectal cancer is the third most common non-skin cancer in both men and women. It is the second leading cause of cancer-related mortality in the United States. Over the past decade, colorectal cancer incidence and mortality rates have decreased in all racial/ethnic populations except American Indians/Alaska Natives. Men and women have similar incidence rates through age 39; at and above age 40, rates are higher in men.

Differences exist between racial/ethnic groups in both incidence and mortality. African Americans have higher mortality rates than all other racial/ethnic groups and higher incidence rates than all except American Indians/Alaska Natives. Incidence and mortality rates are lowest among Hispanics and Asians/Pacific Islanders. Overall colorectal cancer incidence and mortality rates have been declining over the past two decades; these declines have been attributed largely to increased use of screening tests.

Risk factors for colorectal cancer include increasing age, colorectal polyps, a family history of colorectal cancer, certain genetic mutations, excessive alcohol use, obesity, being physically inactive, cigarette smoking, and a history of inflammatory bowel disease. Standard treatments for colorectal cancer include surgery, chemotherapy, radiation therapy, cryosurgery, radiofrequency ablation, and targeted therapy.

Lymphoma

Lymphoma, including Hodgkin lymphoma and non-Hodgkin lymphoma (NHL), is the most common blood cancer in the United States and is estimated to represent approximately 5 percent of all new cancers diagnosed in the United States in 2014. Nearly 71,000 new cases of NHL and nearly 9,200 new cases of Hodgkin lymphoma are estimated for 2014. Incidence rates for Hodgkin lymphoma are highest for whites and African Americans; mortality rates are highest for whites, Hispanics, and African Americans.

Risk factors for both Hodgkin lymphoma and NHL include being male, having a weakened immune system, or being infected with human immunodeficiency virus (HIV) or Epstein-Barr virus. Infection with *Helicobacter pylori* or human T-cell leukemia/lymphoma virus type 1 (HTLV-1) increases the risk for certain types of NHL. The risk of NHL increases with age, whereas the risk of Hodgkin lymphoma is higher in both early adulthood and later life. Standard treatments for both types of lymphoma are chemotherapy, radiation therapy, and stem cell transplant. Additional standard therapies include surgery for Hodgkin lymphoma and targeted therapy, plasmapheresis, watchful waiting and biological therapy for NHL.

B Cell Tumors

In some embodiments, a B cell specific antibody (or portion thereof)/CD19 fusion protein, or a CD19/B-cell specific antibody (or portion) fusion protein described herein is used to treat a subject having a B cell tumor. In some embodiments, an scFv/CD19 fusion protein, e.g., an anti-CD20 scFv/CD19 fusion protein or an anti-CD20 scFv/CD19 fragment fusion protein is used to treat a subject having a B cell tumor. In some embodiments, a CD19/scFv fusion protein, e.g., a CD19/anti-CD20 scFv fusion protein, or a CD19 fragment/anti-CD20 scFv fusion protein, is used to treat a subject having a B cell tumor.

In some embodiments, a B cell specific antibody (or portion thereof)/B cell antigen (or portion) fusion protein, or a B cell antigen (or portion)/B-cell specific antibody (or portion) fusion protein is used to treat a subject having a B cell tumor. In some embodiments, a fusion protein that includes (i) CD22 or portion (e.g., one or more of domains 1-3), CD79 or portion (e.g., CD79a or CD79b), and (ii) a B cell specific antibody or portion (e.g., an anti-CD19, CD20, CD21, CD22, CD72, or CD180 scFv) is used to treat a subject having a B cell tumor.

In some embodiments, a fusion protein that includes a B cell specific antibody (or portion thereof) and CD20 (or portion) is used to treat a subject having a B cell tumor. In some embodiments, a fusion protein that includes a B cell specific antibody (or portion thereof) and a portion of CD20 that is or includes an epitope of CD20 (as described in, e.g., Natarajan et al., Clin. Cancer Res. 19:6820-9 (2013)) is used to treat a subject having a B cell tumor.

In some embodiments, a subject having a B cell tumor is treated with one or more of these fusion proteins as a protein therapeutic. In some embodiments, a subject having a B cell tumor is treated with a cellular therapeutic that includes a constitutive expression construct described herein that encodes one or more of these fusion proteins. In some embodiments, a subject having a B cell tumor is treated with a naked nucleic acid encoding one or more of these fusion proteins, or is treated with a viral vector described herein that includes a nucleic acid encoding such fusion protein.

Hematological Malignancies

In some embodiments, a fusion protein described herein that includes (i) an antigen-binding protein that binds to a TSA and (ii) CD19 or portion thereof is used to treat a subject having a hematological malignancy. In some embodiments, a TSA binding protein (e.g., an anti-TSA antibody (or portion thereof)/CD19 fusion protein, or a CD19/TSA binding protein (e.g., anti-TSA antibody) fusion protein is used to treat a subject having a hematological malignancy. In some embodiments, a hematological malignancy is a malignancy of hematological cells not defined by CD19 expression. In some embodiments, a hematological malignancy may be a non-B cell lineage malignancy. In some embodiments, a hematological malignancy may include, for example, a myeloid malignancy (e.g., acute myeloid malignancy), plasma cell malignancy, and myelodysplatic malignancy. In some embodiments, A TSA-binding protein (e.g., an anti-TSA antibody) can bind to any known TSA, e.g., any TSA described herein. In some embodiments, a TSA is ROR1, BCMA, CS1, CD33, CD123, CD38, CD138, or CLL-1/CLECK12A.

In some embodiments, a fusion protein described herein that includes (i) an antigen-binding protein that binds to a TSA and (ii) a B cell antigen or portion thereof is used to treat a subject having a hematological malignancy. In some embodiments, a TSA binding protein (e.g., an anti-TSA antibody (or portion thereof))/B cell antigen fusion protein, or a B cell antigen/TSA binding protein (e.g., anti-TSA antibody) fusion protein is used to treat a hematological malignancy. In some embodiments, a fusion protein includes a B cell antigen or portion (e.g., CD20 or portion (e.g., an epitope as described in, e.g., Natarajan et al., Clin. Cancer Res. 19:6820-9 (2013), CD22 or portion (e.g., one or more of domains 1-3), or CD79 or portion (e.g., CD79a or CD79b)).

In some embodiments, a subject having a hematological malignancy is treated with one or more of these fusion proteins as a protein therapeutic. In some embodiments, a subject having a hematological malignancy is treated with a cellular therapeutic that includes a constitutive expression construct described herein that encodes one or more of these fusion proteins. In some embodiments, a subject having a hematological malignancy is treated with a naked nucleic acid encoding one or more of these fusion proteins, or is treated with a viral vector described herein that includes a nucleic acid encoding such fusion protein.

Solid Tumors

In some embodiments, a cellular therapeutic described herein that includes a constitutive expression construct can be used to treat a subject having a solid tumor. In some embodiments, the constitutive expression construct encodes a fusion protein described herein that includes (i) an antigen binding protein that targets a TSA, and (ii) a target for a second cellular therapeutic, antibody, or antibody-drug conjugate. In some embodiments, a cellular therapeutic described herein that includes an inducible expression construct can be used to treat a subject having a solid tumor. In some embodiments, the inducible expression construct encodes a fusion protein described herein that includes (i) an antigen binding protein that targets a TSA or TAA, and (ii) a target for a second cellular therapeutic, antibody, or antibody-drug conjugate. In some embodiments, a fusion protein that is or includes a masked construct or portion thereof (described herein) is used to treat a subject having a solid tumor. In some embodiments, a fusion protein that includes a masked antigen-binding protein (that, when unmasked, binds a TAA described herein) and CD19 or fragment is used to treat a subject having a solid tumor.

In some embodiments, a subject having a solid tumor is treated with one or more of these fusion proteins as a protein therapeutic. In some embodiments, a subject having a solid tumor is treated with a cellular therapeutic that includes a constitutive expression construct described herein that encodes one or more of these fusion proteins. In some embodiments, a subject having a solid tumor is treated with a naked nucleic acid encoding one or more of these fusion proteins, or is treated with a viral vector described herein that includes a nucleic acid encoding such fusion protein.

Combination Therapy

As described herein, in some embodiments, a cellular therapeutic and/or a protein therapeutic is administered in combination with a second cellular therapeutic, an antibody-drug conjugate, an antibody, and/or a polypeptide. In some embodiments, the extent of tumor targeting and/or killing by a second cellular therapeutic (e.g., CAR-T cell) is higher than a level observed or measured in the absence of combined therapy with a cellular therapeutic or a protein therapeutic described herein.

A pharmaceutical composition comprising a cellular therapeutic and/or a protein therapeutic described herein can optionally contain, and/or be administered in combination with, one or more additional therapeutic agents, such as a cancer therapeutic agent, e.g., a chemotherapeutic agent or a biological agent. Examples of chemotherapeutic agents that can be used in combination with a cellular therapeutic described herein include platinum compounds (e.g., cisplatin, carboplatin, and oxaliplatin), alkylating agents (e.g., cyclophosphamide, ifosfamide, chlorambucil, nitrogen mustard, thiotepa, melphalan, busulfan, procarbazine, streptozocin, temozolomide, dacarbazine, and bendamustine), antitumor antibiotics (e.g., daunorubicin, doxorubicin, idarubicin, epirubicin, mitoxantrone, bleomycin, mytomycin C, plicamycin, and dactinomycin), taxanes (e.g., paclitaxel and docetaxel), antimetabolites (e.g., 5-fluorouracil, cytarabine, premetrexed, thioguanine, floxuridine, capecitabine, and methotrexate), nucleoside analogues (e.g., fludarabine, clofarabine, cladribine, pentostatin, and nelarabine), topoisomerase inhibitors (e.g., topotecan and irinotecan), hypomethylating agents (e.g., azacitidine and decitabine), proteosome inhibitors (e.g., bortezomib), epipodophyllotoxins (e.g., etoposide and teniposide), DNA synthesis inhibitors (e.g., hydroxyurea), vinca alkaloids (e.g., vicristine, vindesine, vinorelbine, and vinblastine), tyrosine kinase inhibitors (e.g., imatinib, dasatinib, nilotinib, sorafenib, and sunitinib), nitrosoureas (e.g., carmustine, fotemustine, and lomustine), hexamethylmelamine, mitotane, angiogenesis inhibitors (e.g., thalidomide and lenalidomide), steroids (e.g., prednisone, dexamethasone, and prednisolone), hormonal agents (e.g., tamoxifen, raloxifene, leuprolide, bicaluatmide, granisetron, and flutamide), aromatase inhibitors (e.g., letrozole and anastrozole), arsenic trioxide, tretinoin, nonselective cyclooxygenase inhibitors (e.g., nonsteroidal anti-inflammatory agents, salicylates, aspirin, piroxicam, ibuprofen, indomethacin, naprosyn, diclofenac, tolmetin, ketoprofen, nabumetone, and oxaprozin), selective cyclooxygenase-2 (COX-2) inhibitors, or any combination thereof.

Examples of biological agents that can be used in the compositions and methods described herein include monoclonal antibodies (e.g., rituximab, cetuximab, panetumumab, tositumomab, trastuzumab, alemtuzumab, gemtuzumab ozogamicin, bevacizumab, catumaxomab, denosumab, obinutuzumab, ofatumumab, ramucirumab, pertuzumab, ipilimumab, nivolumab, nimotuzumab, lambrolizumab, pidilizumab, siltuximab, BMS-936559, RG7446/MPDL3280A, MEDI4736, tremelimumab, or others listed in Table 1 herein), enzymes (e.g., L-asparaginase), cytokines (e.g., interferons and interleukins), growth factors (e.g., colony stimulating factors and erythropoietin), cancer vaccines, gene therapy vectors, or any combination thereof.

In some embodiments, treatment methods described herein are performed on subjects for which other treatments of the medical condition have failed or have had less success in treatment through other means. Additionally, the treatment methods described herein can be performed in conjunction with one or more additional treatments of the medical condition. For instance, the method can comprise administering a cancer regimen, e.g., nonmyeloablative chemotherapy, surgery, hormone therapy, and/or radiation, prior to, substantially simultaneously with, or after the administration of a cellular therapeutic and/or a protein therapeutic described herein, or composition thereof. In certain embodiments, a subject to which a cellular therapeutic and/or a protein therapeutic described herein is administered can also be treated with antibiotics and/or one or more additional pharmaceutical agents.

Exemplary amino acid and nucleotide sequences of the disclosure are listed in the following Table:

| Amino acid SEQ ID NO: | Nucleotide SEQ ID NO: | Name |
| --- | --- | --- |
| 1 | 201 | Panitumumab Heavy Chain (HC) |
| 2 | 202 | CD19-D1-Panitumumab Light Chain (LC) |
| 3 | 203 | CD19-D1-Panitumumab HC |
| 4 | 204 | Panitumumab LC |
| 5 | 205 | Panitumumab LC-CD19-D1 |
| 6 | 206 | Panitumumab HC-CD19-D1 |
| 7 | 207 | LY2875358 HC |
| 8 | 208 | CD19-D1-LY2875358 LC |
| 9 | 209 | CD19-D1-LY2875358 HC |
| 10 | 210 | LY2875358 LC |
| 11 | 211 | LY2875358 LC-CD19-D1 |
| 12 | 212 | LY2875358 HC-CD19-D1 |
| 13 | 213 | FMC63 CAR-19 construct |
| 14 | 214 | CD19-D1 |
| 15 | 215 | CD19-D1-huIgGFc |
| 16 | 216 | Trastuzumab scFv (VH/VL) |
| 17 | 217 | MOC31 scFv (VH/VL) |
| 18 | 218 | MOC31 scFv (VL/VH) |
| 19 | 219 | LY2875358 scFv (VH/VL) |
| 20 | 220 | LY2875358 scFv (VL/VH) |
| 21 | 221 | Panitumumab scFv (VH/VL) |
| 22 | 222 | Panitumumab scFv (VL/VH) |
| 23 | 223 | CD19-D1 + 2-soluble TNF |
| 24 | 224 | Trastuzumab scFv (VH/VL)-CD19-D1 |
| 25 | 225 | Trastuzumab scFv (VH/VL)-CD19-D1-huIgGFc |
| 26 | 226 | CD19-D1-Trastuzumab scFv (VH/VL) |
| 27 | 227 | CD19-D1-Trastuzumab scFv (VH/VL)-huIgGFc |
| 28 | 228 | CD19-D1 + 2 |
| 29 | 229 | CD19-D1 + D2-huIgGFc |
| 30 | 230 | CD19-D2 |
| 31 | 231 | CD19-D2-huIgGFc |
| 32 | 232 | CD19-D1 + 2-Panitumumab LC |
| 33 | 233 | CD19-D1 + 2-Panitumumab HC |
| 34 | 234 | Panitumumab LC-CD19-D1 + 2 |
| 35 | 235 | Panitumumab HC-CD19-D1 + 2 |
| 36 | 236 | CD19-D1 + 2-LY2875358 LC |
| 37 | 237 | CD19-D1 + 2-LY2875358 HC |
| 38 | 238 | LY2875358 LC-CD19-D1 + 2 |
| 39 | 239 | LY2875358 HC-CD19-D1 + 2 |
| 40 | 240 | Trastuzumab scFv (VH/VL)-CD19-D1 + 2 |
| 41 | 241 | Trastuzumab scFv (VH/VL)-CD19-D1 + 2-huIgGFc |
| 42 | 242 | CD19-D1 + 2-Trastuzumab scFv (VH/VL) |
| 43 | 243 | CD19-D1 + 2-Trastuzumab scFv (VH/VL)-huIgGFc |
| 46 | 246 | human CD69 promoter-tGFP |
| 47 | 247 | human TNFalpha promoter-tGFP |
| 48 | 248 | mouse CD25 promoter-tGFP |
| 49 | 249 | NFAT element × 6 promoter-tGFP |
| 50 | 250 | CD19-ECD-Panitumumab HC |
| 51 | 251 | CD19-ECD-LY2875358 HC |
| 52 | 252 | CD19-ECD-MOC31 scFv (VH/VL) |
| 53 | 253 | CD19-ECD-LY2875358-scFv (VH/VL) |
| 54 | 254 | CD19-ECD-Panitumumab scFv (VH/VL) |
| 55 | 255 | CD19-ECD-Trastuzumab scFv (VH/VL) |

-continued

| Amino acid SEQ ID NO: | Nucleotide SEQ ID NO: | Name |
|---|---|---|
| 56 | 256 | CD19-ECD-huIgGFc-Trastuzumab scFv (VH/VL) |
| 57 | 257 | Her2-ECD-Panitumumab scFv (VH/VL) |
| 58 | 258 | Her2-D4-Panitumumab scFv (VH/VL) |
| 63 | 263 | CD19-ECD-Leu16 scFv (VH/VL) |
| 64 | 264 | CD22-D123-FMC63 scFv (VH/VL) |
| 65 | 265 | CD22-D123-Leu16 scFv (VH/VL) |
| 66 | 266 | CMV promoter-tGFP |
| 67 | 267 | CD19-ECD-anti-EGFRvIII scFv (VL/VH) |
| 68 | 268 | CD22-D123-anti-EGFRvIII scFv (VH/VL) |
| 71 | 271 | FMC63 CAR-19 construct Flag-tagged-1 |
| 72 | 272 | FMC63 CAR-19 construct Flag-tagged-2 |
| 73 | 273 | CD19 FMC63 CAR and CMV - #42 |
| 74 | 274 | CD19 FMC63 CAR and CD25 promoter - #42 |
| 75 | 275 | CD19 FMC63 CAR and CD69 promoter - #42 |
| 76 | 276 | CD19 FMC63 CAR and TNF promoter - #42 |
| 77 | 277 | CD19 FMC63 CAR and NFAT promoter- #42 |
| 78 | 278 | Leu16 scFv (VH/VL)-huIgGFc |
| 79 | 279 | Leu16 scFv (VH/VL) |
| 80 | 280 | Leu16 scFv (VL/VH)-huIgGFc |
| 81 | 281 | Leu16 scFv (VL/VH) |
| 82 | 282 | CD19-D1 + 2-Leu16 scFv (VH/VL)-huIgGFc |
| 83 | 283 | CD19-D1 + 2-Leu16 scFv (VH/VL) |
| 84 | 284 | CD19-D1 + 2-Leu16 scFv (VL/VH)-huIgGFc |
| 85 | 285 | CD19-D1 + 2-Leu16 scFv (VL/VH) |
| 86 | 286 | CD19-D1 + 2-MOC31 scFv (VH/VL) |
| 87 | 287 | CD19-D1 + 2-Ly2875358 scFv (VH/VL) |
| 88 | 288 | CD19 D1 + 2-Panitumumab scFv (VH/VL) |
| 89 | 289 | C11D5.3 scFv (VL/VH) |
| 90 | 290 | C11D5.3 scFv (VH/VL) |
| 91 | 291 | CD19-D1 + 2-C11D5.3 scFv (VL/VH) |
| 92 | 292 | CD19-D1 + 2-C11D5.3 scFv (VH/VL) |
| 93 | 293 | CD19-D1 + 2-huIgGFc-Trastuzumab (VH/VL) |
| 94 | 294 | Bispecific CD19-D1 + D2-Trastuzumab scFv (VH/VL)-Panitumumab scFv (VH/VL) |
| 95 | 295 | Bispecific CD19-D1 + D2-Trastuzumab scFv (VH/VL)-Panitumumab scFv (VL/VH) |
| 96 | 296 | Bispecific Trastuzumab scFv-Panitumumab scFv (VH/VL) |
| 97 | 297 | Bispecific Trastuzumab scFv-Panitumumab scFv (VL/VH) |
| 98 | 298 | lentiviral CMV promoter - #42 |
| 99 | 299 | lentiviral CD25 promoter - #42 |
| 100 | 300 | lentiviral CD69 promoter - #42 |
| 101 | 301 | lentiviral TNFa promoter - #42 |
| 102 | 302 | lentiviral NFAT x 6 promoter - #42 |
| 103 | 303 | Trastuzumab scFv (VH/VL)-huIgGFc |
| 104 | 304 | CD19-D1 + 2-extended linker-Leu16 scFv (VH/VL)-huIgGFc |
| 105 | 305 | CD19-D1 + 2-extended linker-Leu16 scFv (VH/VL) |
| 106 | 306 | CD19-D1 + 2-huIgGFc-Leu16 scFv (VH/VL) |
| 107 | 307 | Leu16 scFv (VH/VL)-CD19-D1 + 2-huIgGFc |
| 108 | 308 | EF1a - #72 - T2A - #42 |
| 109 | 309 | EF1a - #42 - T2A - #72 |
| 110 | 310 | #98 EF1a promoter and CMV (variant) |
| 111 | 311 | #42 EF1a promoter (pCDH-EF1a) |
| 112 | 312 | CD19 full ECD |

In any of the embodiments described herein, a protein and/or construct described herein has an amino acid sequence having at least 80%, 85%, 90%, 91%, 92%, 93%, 94%, 95%, 96%, 97%, 98%, or 99% identity to a disclosed amino acid sequence, and/or is encoded by a nucleotide sequence having at least 80%, 85%, 90%, 91%, 92%, 93%, 94%, 95%, 96%, 97%, 98%, or 99% identity to a disclosed nucleotide sequence herein.

All publications, including GENBANK sequences, cited herein are expressly incorporated by reference herein.

EXEMPLIFICATION

Example 1. Construction and Expression of Antibody-CD19 Fusion Proteins

Figure 13:
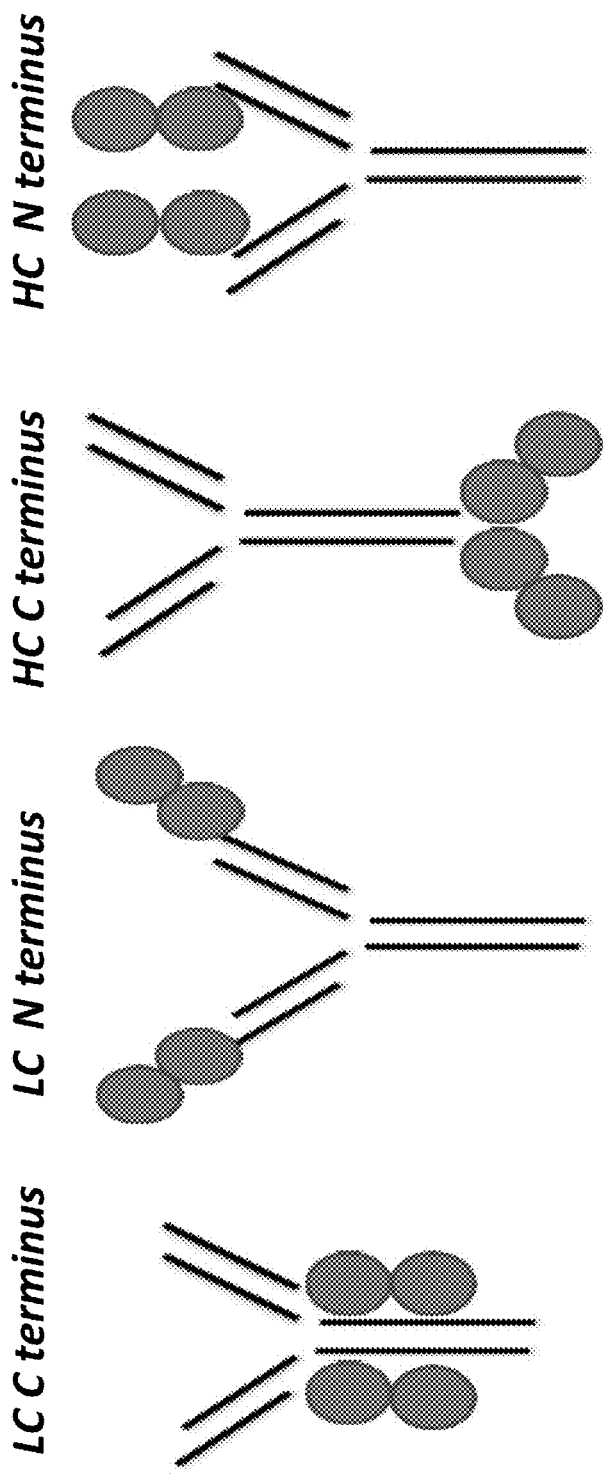
FIG. 13 is a schematic depicting exemplary antibody fusion proteins in which a polypeptide antigen is fused to the C terminus of a light chain (LC) of an antibody, a polypeptide antigen is fused to the N terminus of a LC of an antibody, a polypeptide antigen is fused to the C terminus of a heavy chain (HC) of an antibody, or a polypeptide antigen is fused to the N terminus of a HC of an antibody.

Fusion proteins containing CD19 and either full-length antibodies or scFvs were produced using anti-EGFR monoclonal antibody panitumumab, humanized anti-c-MET monoclonal antibody LY2875358 (emibetuzumab), or anti-HER2 monoclonal antibody trastuzumab. The extracellular domain of CD19 lacking 13 amino acids at the C-terminus and including the two C2-type Ig domains of CD19 ("CD19-D1+D2", which includes the non-coding and coding sequences of exons 1-4 in the CD19 gene) were fused to the full length antibodies in various orientations, as depicted schematically in FIG. 13. In some constructs only CD19 domain 1 ("CD19-D1") or domain 2 ("CD19-D2") was used for the fusion protein. In some constructs the full-length extracellular domain of CD19 ("CD19-ECD"; SEQ ID NO: 112) was used.

Panitumumab-CD19 fusion proteins were produced in 293T cells by expressing vectors containing nucleic acids encoding panitumumab-CD19 fusion proteins. Coding sequences for the heavy and light chains of panitumumab described herein were used to design synthetic gene sequences in pcDNA-1 derived vectors. The synthetic gene sequences encoded panitumumab antibody sequences in which the CD19 D1+D2 domain was fused, in frame, at either the N-terminus of the heavy chain, or at the C-terminus of the heavy chain, or at the N-terminus of the light chain, or at the C-terminus of the light chain.

LY2875358-CD19 fusion proteins were produced by expressing vectors containing nucleic acids encoding LY2875358-CD19 fusion proteins in 293T cells. Coding sequences for the heavy and light chains of LY2875358 (described herein) were used to design synthetic gene sequences in pcDNA-1 derived vectors. The synthetic gene sequences encoded LY2875358 antibody sequences in which the CD19 D1+D2 domain was fused, in frame, at either the N-terminus of the heavy chain, or at the C-terminus of the heavy chain, or at the N-terminus of the light chain, or at the C-terminus of the light chain. In some constructs only CD19-D1 or CD19-D2 was used for the fusion protein. In some constructs CD19-ECD was used.

The 293T cells were cultured to be at 90-95% confluence at the time of transfection. At Day 0, cells were seeded at 1×10e6 in 2 ml/well (6 well per plate), and cultured overnight. The cells reached ~90% confluence on day 1. Vector DNAs encoding heavy and light chains were mixed with the transfection reagent. On day 1, 150 μl serum-free OptiMEM™ (Gibco) was mixed with 10 μl Lipofectamine™ 2000 (Invitrogen™) and incubated at room temperature for 5 minutes (Part A). In another tube, 2.5 μg of each vector DNA (heavy and light chains) were mixed (Part B) then 150 μl serum-free OptiMEM™ was added. Parts A and B were then gently mixed and incubated at room temperature for 20 minutes. The transfection reagent was then added directly into the well with cells in 2 ml cell culture medium. The cell culture supernatant was harvested after 48 hours.

Figure 14A:
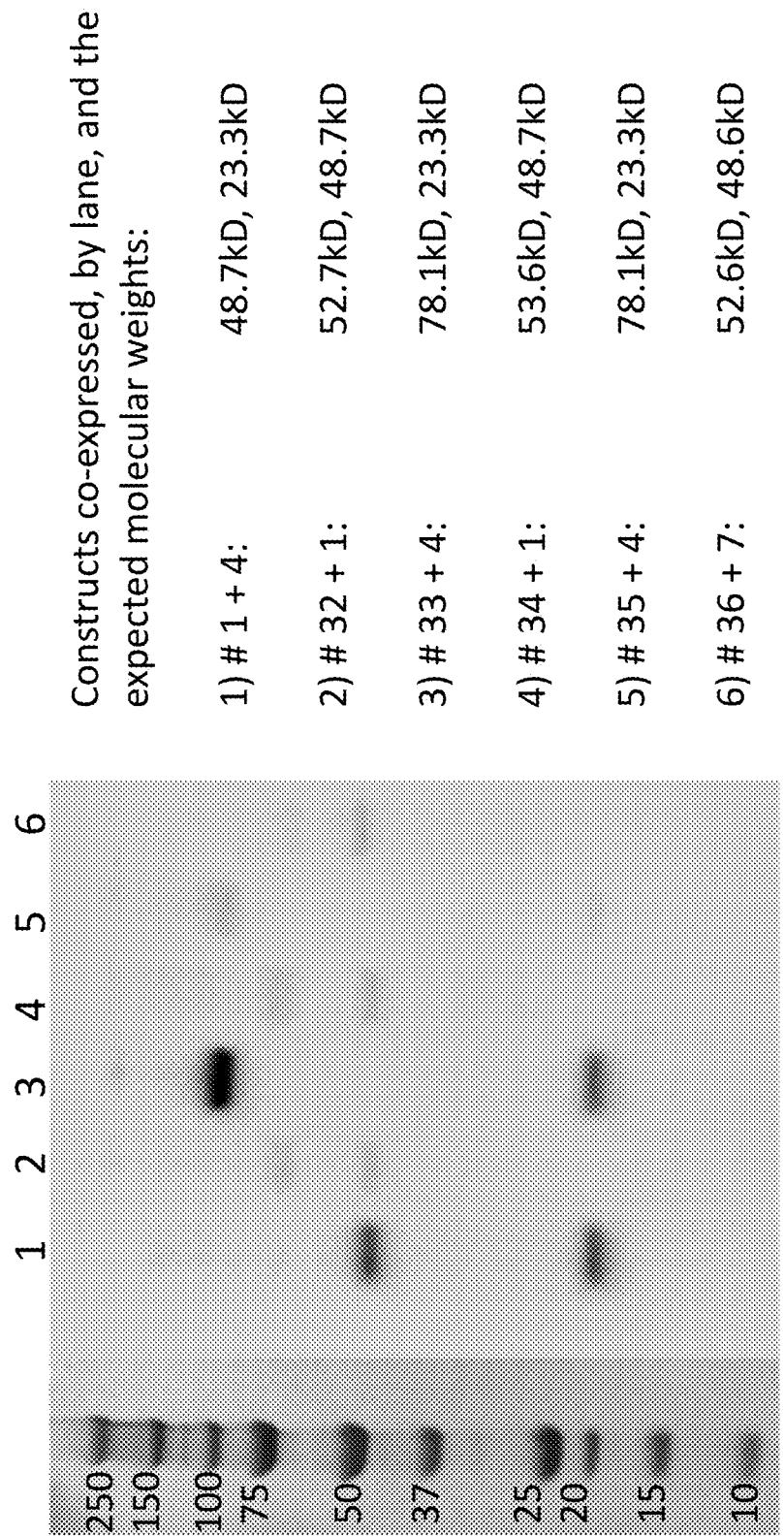
FIGS. 14A and 14B show expression levels of various polypeptide antigen-antibody fusion constructs.
Figure 14B:
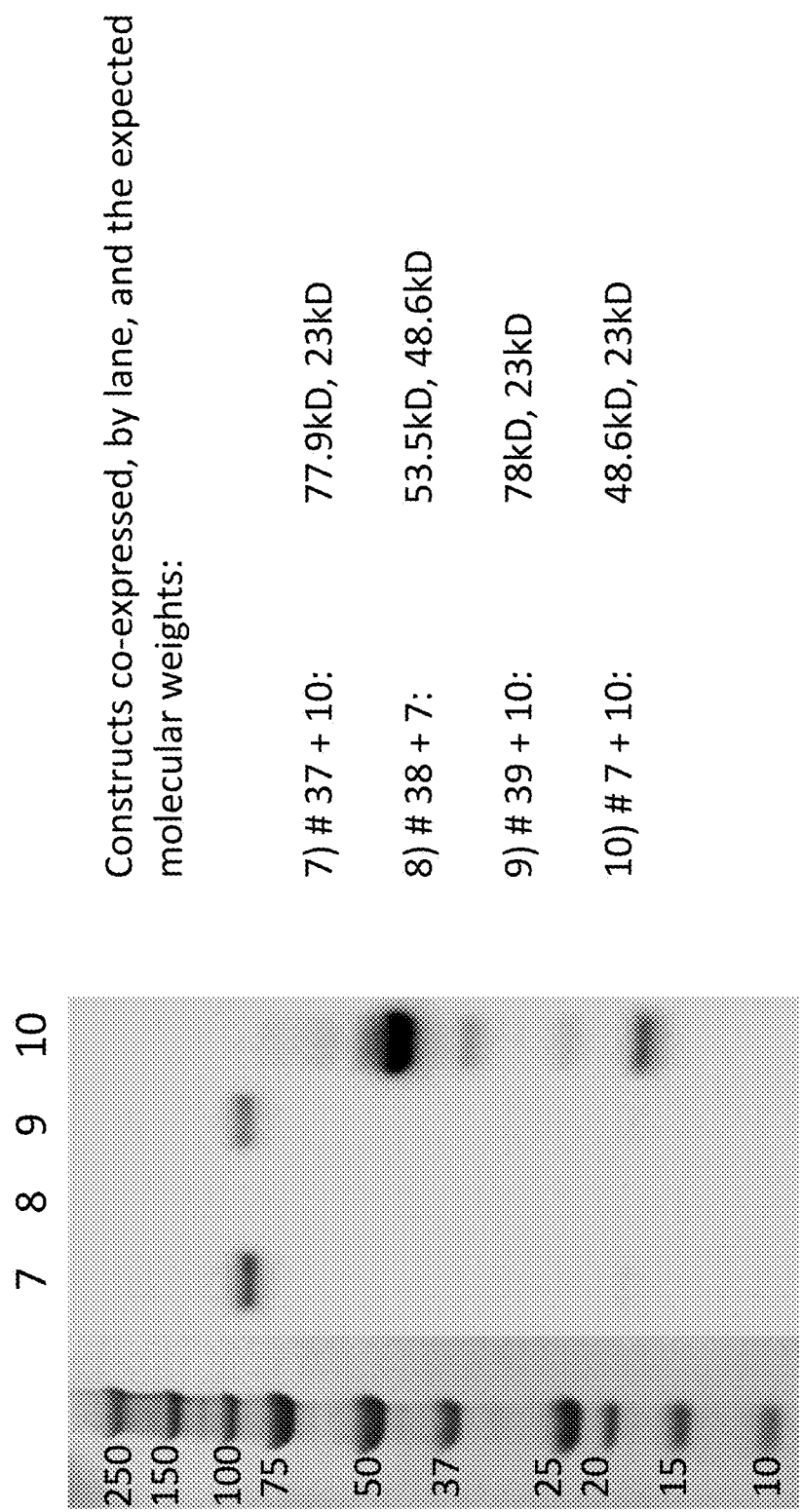

Expression levels of panitumumab-CD19 and LY2875358-CD19 fusion proteins were determined by Western blot analysis from cultures of cells expressing the fusion proteins. 1 ml of supernatant was taken from the cell cultures 48 hours after transfection. The cell culture media was mixed with 20 μl 50% rProtein A SEPHAROSE® Fast Flow slush in PBS (GE Healthcare) for 3 hours at room temperature, with gentle rocking. The protein-A beads, with captured antibodies bound, were spun down by centrifugation and washed with PBS. The wash step was repeated. Then, 20 µl 2× Laemmli Sample buffer (Bio-Rad), including DTT as a reducing reagent, was added to remove any antibodies that had been captured by the beads. The lysates (10 µl) were loaded onto a 4-20% polyacrylamide gel from Bio-Rad in order to separate the proteins under reducing conditions. The heavy and light chains were identified by using a peroxidase-coupled anti-human IgG polyclonal antibody. The peroxidase signal was detected enzymatically using SuperSignal™ West Femto Maximum Sensitivity Substrate (Thermo Fisher), and the resulting bands were imaged using Chemi Doc MP Imaging System (Bio-Rad) and Image Lab software. Expression levels are depicted in FIGS. 14A and 14B. In FIGS. 14A and 14B, expression of the following constructs is shown: panitumumab heavy chain (SEQ ID NO:1) and panitumumab light chain (SEQ ID NO:4) (construct "1+4"); CD19-D1+2-panitumumab LC (SEQ ID NO:32) and panitumumab HC (SEQ ID NO:1) (construct "32+1"); CD19-D1+2-Panitumumab HC (SEQ ID NO:33) and panitumumab LC (SEQ ID NO:4) (construct "33+4"); Panitumumab LC-CD19-D1+2 (SEQ ID NO:34) and panitumumab HC (SEQ ID NO:1) (construct "34+1"); Panitumumab HC-CD19-D1+2 (SEQ ID NO:35) and panitumumab LC (SEQ ID NO:4) (construct "35+4"); CD19-D1+2-LY2875358 LC (SEQ ID NO:36) and LY2875358 HC (SEQ ID NO:7) (construct "36+7"); CD19-D1+2-LY2875358 HC (SEQ ID NO:37) and LY2875358 LC (SEQ ID NO:10) (construct "37+10"); LY2875358 LC-CD19-D1+2 (SEQ ID NO:38) and LY2875358 HC (SEQ ID NO:7) (construct "38+7"); LY2875358 HC-CD19-D1+2 (SEQ ID NO:39) and LY2875358 LC (SEQ ID NO:10) (construct "39+10"); LY2875358 HC (SEQ ID NO:7) and LY2875358 LC (SEQ ID NO:10) (construct "7+10").

As shown in FIG. 14, CD19-containing heavy and light chains were detectible and ran at a higher molecular weight than the unmodified heavy and light chains (compare, e.g., lanes 1 and 3 on FIG. 14A (panituzumab) and lanes 7 and 10 on FIG. 14B (LY2875358)).

scFv-CD19 fusion proteins were produced using scFv from anti-HER2 antibody trastuzumab and CD19 fused to the N-terminus or the C-terminus of the scFv (i.e., the linked VH and VL sequences of the parental antibody), as depicted schematically in FIG. 15. The scFv-CD19 fusion proteins were designed to include a C-terminal HIS tag (e.g., constructs #40 and 42) or a hinge-CH2-CH3 from human IgG ("huIgGFc") (e.g., constructs #41 and 43). In some constructs only CD19-D1 or CD19-D2 was used for the fusion protein. In some constructs CD19-ECD was used.

Figure 16:
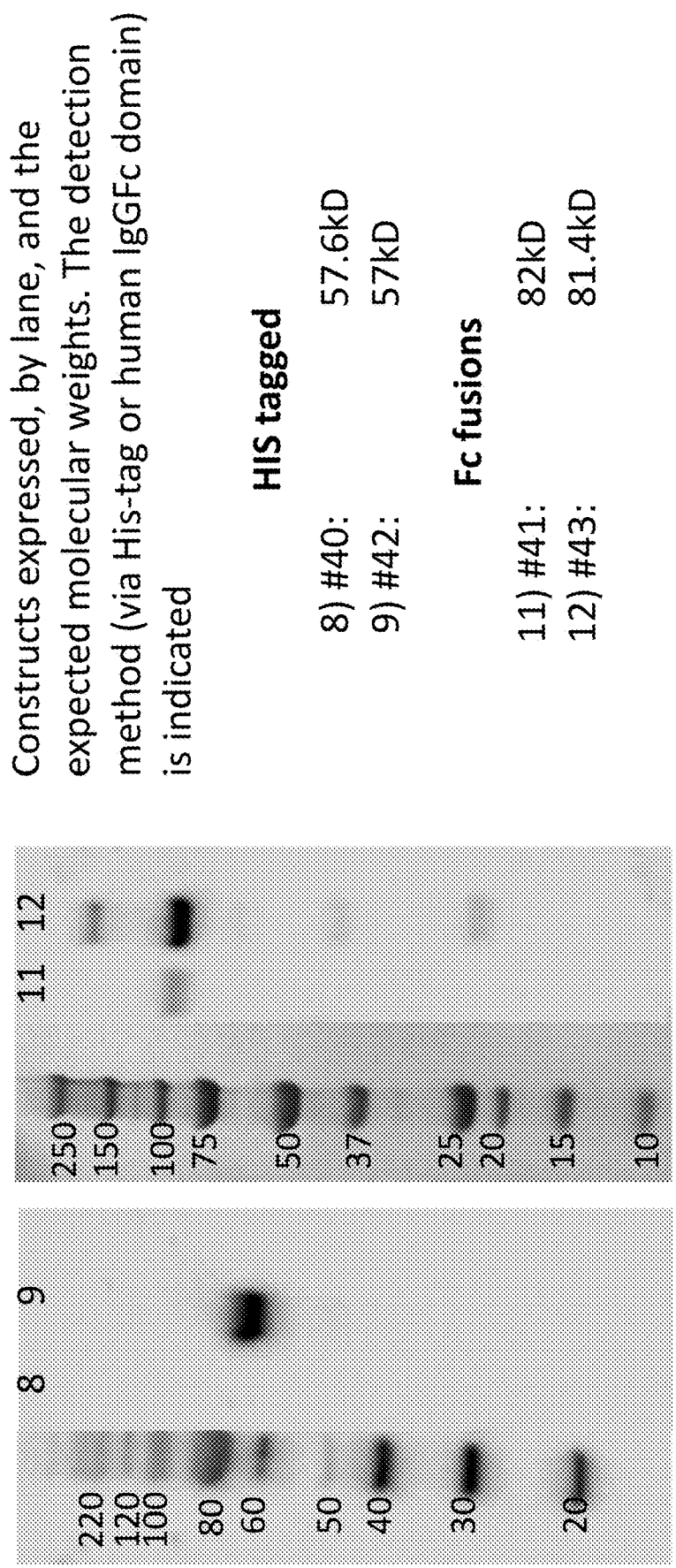
FIG. 16 shows expression levels of various polypeptide antigen-scFv fusion constructs.
Figure 17A:
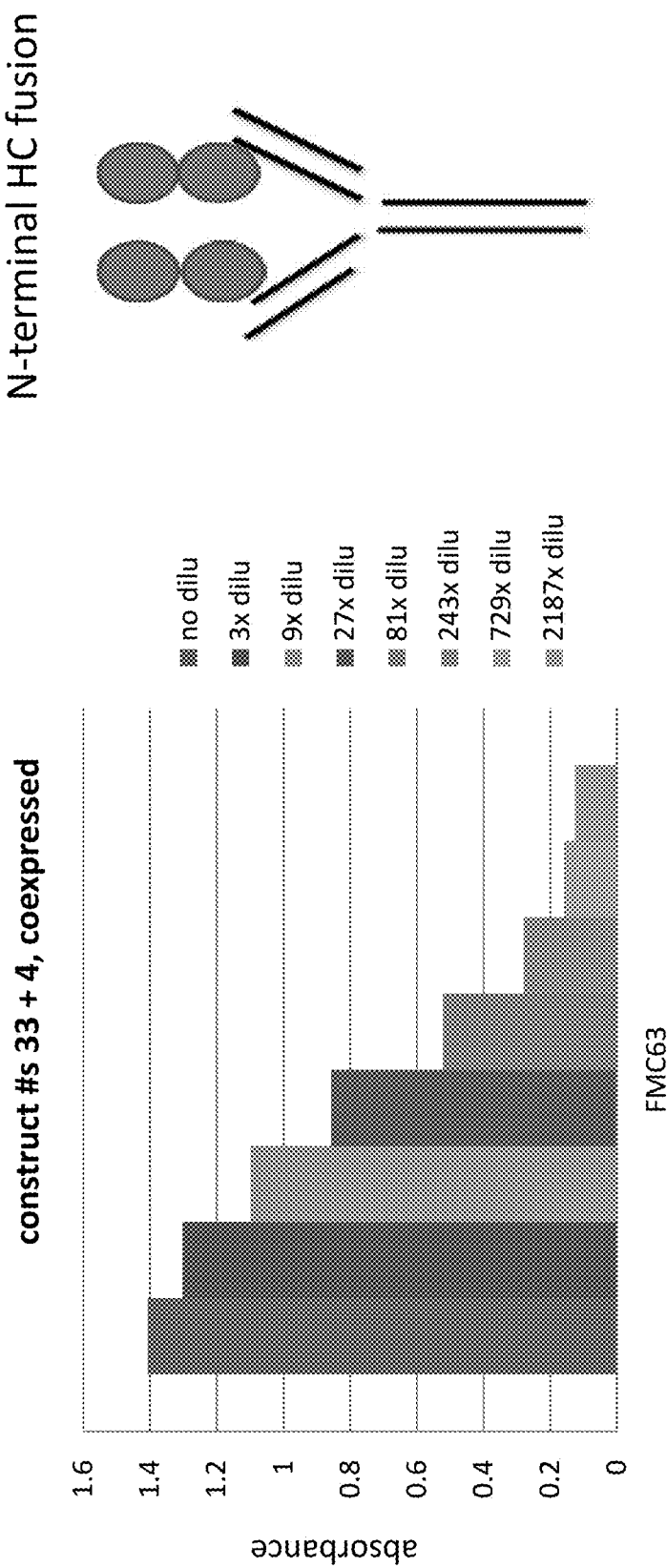
FIGS. 17A, 17B, 17C, and 17D show binding of panitumumab-CD19 fusion proteins to an anti-CD19 antibody (FMC63).
Figure 17B:
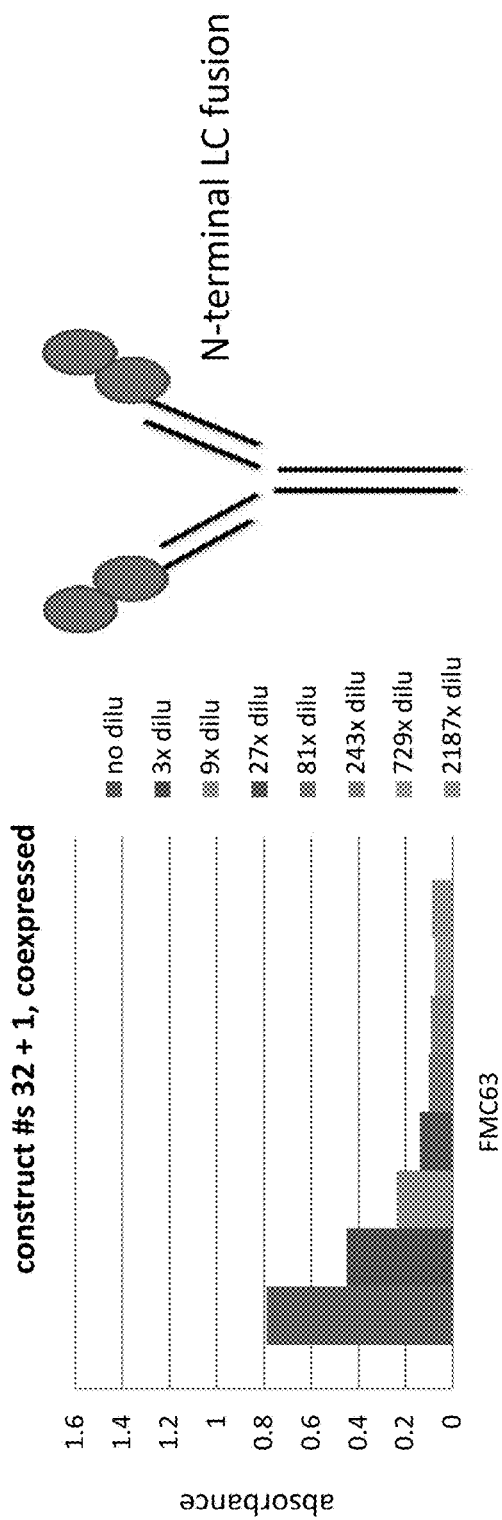
Figure 17C:
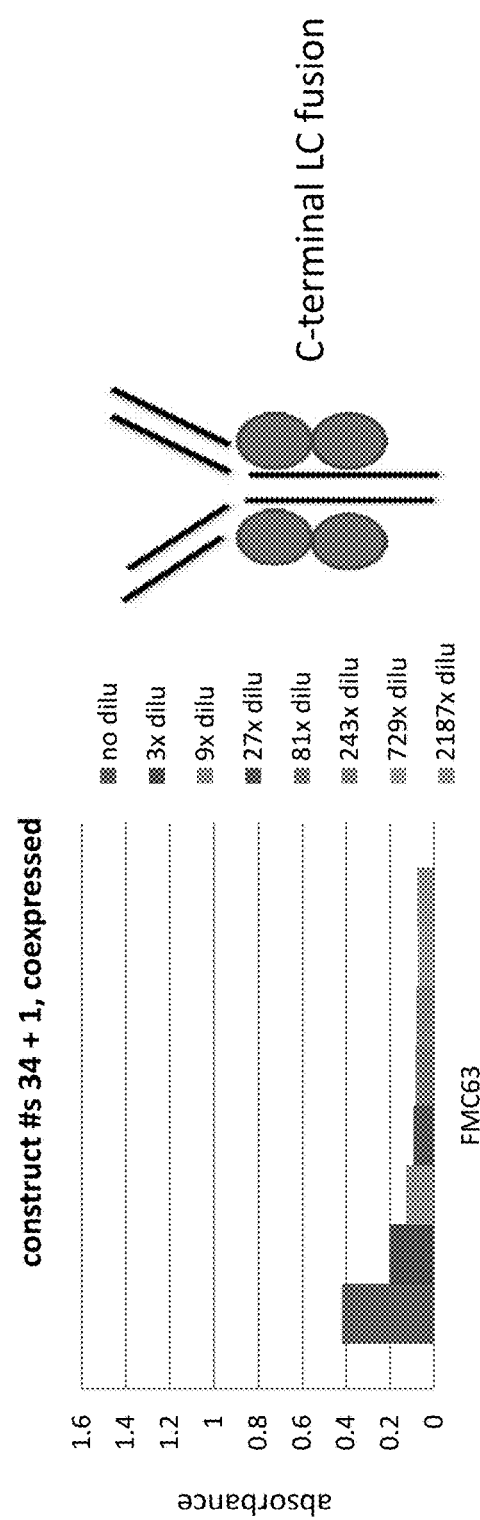
Figure 17D:
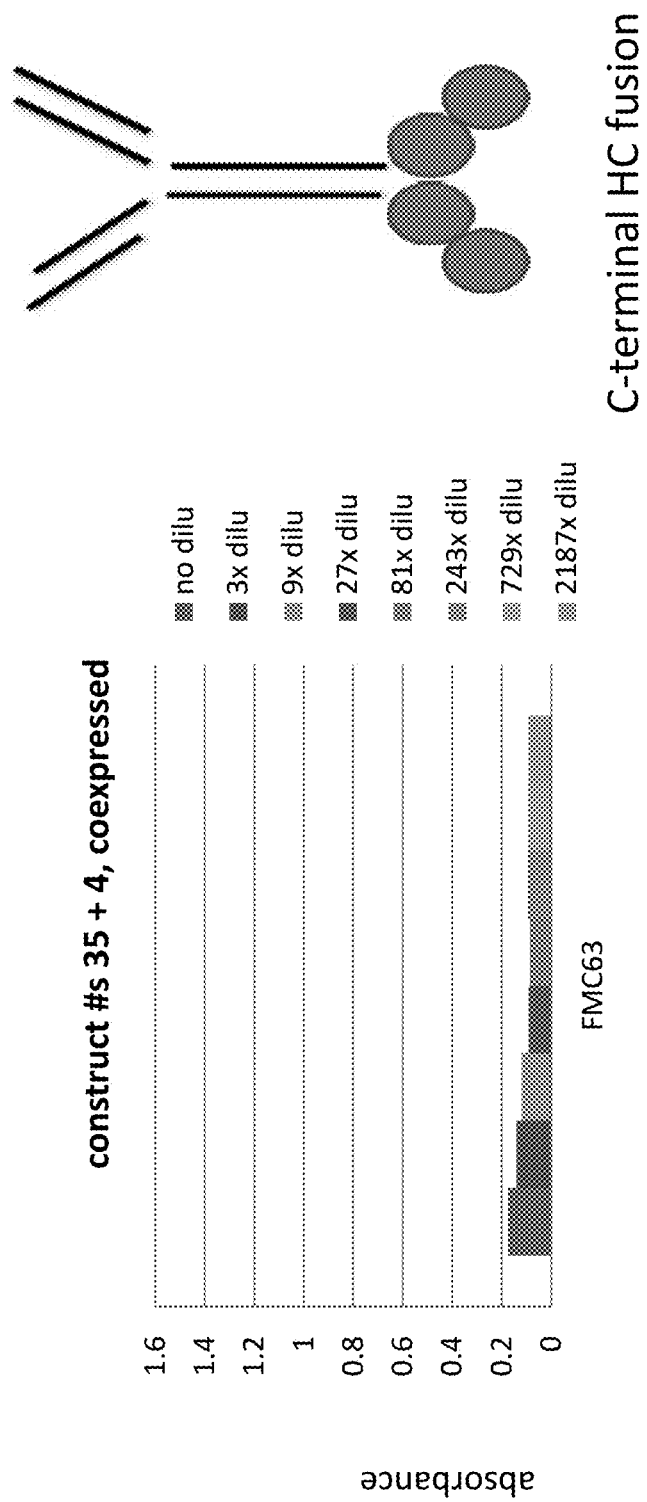

The scFv-CD19 fusion proteins were expressed in 293T cells using the same methods as described above, except that only one vector encoding the sequences to be expressed was used, as the construct is linear. The expression levels of the scFv-fusion proteins were determined by Western blot analysis. The Fc-tagged scFv fusion proteins were immunoprecipitated using protein-A coated beads, run on a reducing gel, and detected via anti-human IgG peroxidase staining and enzymatic detection. The HIS-tagged scFv fusion proteins were immunoprecipitated using anti-HIS resin (R&D Systems) and detected with an anti-HIS polyclonal antibody-peroxidase conjugate and enzymatic detection. The expression of trastuzumab scFv-CD19 fusion proteins is shown in FIG. 16.

Example 2. Antibody-CD19 Fusion Proteins are Recognized by Anti-CD19 Antibody

The ability of an anti-CD19 antibody (FMC63) to bind to the various antibody-CD19 fusion proteins described in Example 1 was determined using a variety of methods to demonstrate specific binding.

Figure 18:
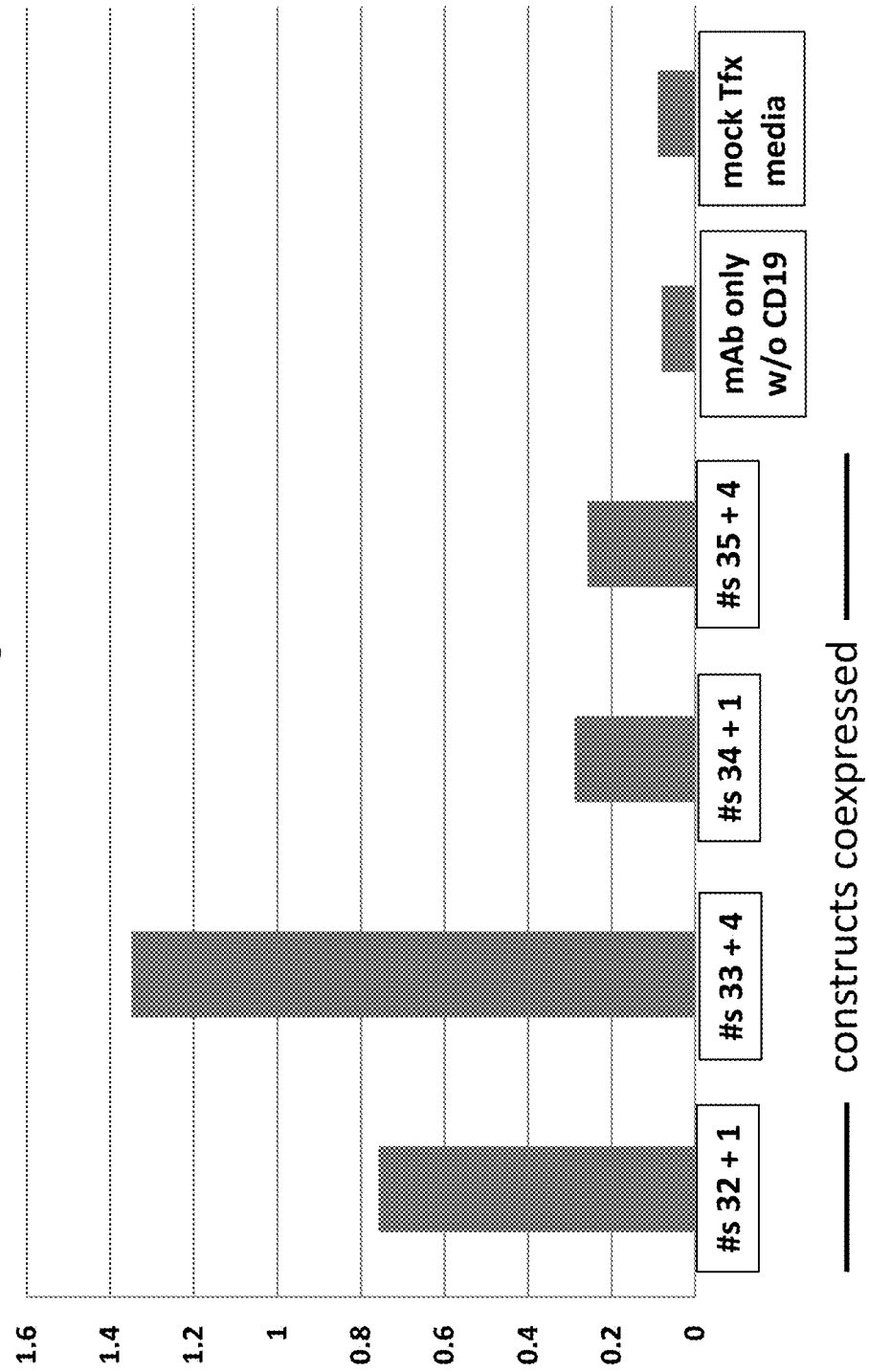
FIG. 18 shows binding of panitumumab-CD19 fusion proteins to an anti-CD19 antibody (FMC63) relative to negative controls.

FIGS. 17A-17D depict binding of panitumumab-CD19 fusion proteins described in Example 1 to FMC63. ELISA plates (Pierce) were coated with 1 µg/ml FMC63 anti-human CD19 antibody (Millipore) at 4° C. overnight. The plate was blocked with 0.3% NF dry milk in TBS for 1 hour at room temperature. Cell culture supernatants were added directly to the wells in ELISA buffer followed with a 1:3 to 1:2187 dilution, in series. The ELISA plates were gently washed with TBST (50 mM Tris, 150 mM NaCl, 0.05% TWEEN® 20) ELISA buffer, three times, and then peroxidase-conjugated polyclonal anti-human IgG was added to detect the bound human antibodies. In this assay format, the human antibodies are retained via binding of CD19 to the FMC63 coated on the plate surface. Additional controls were run to demonstrate specificity (depicted in FIG. 18). "mAb only" indicates addition of the parental antibody that does not carry a CD19 fusion, and "mock Tfx" indicates the addition of media from wells that were treated with the transfection protocol, but without any added vectors. The binding was demonstrated to be above background for all four fusion proteins tested (corresponding to N and C terminal fusions of CD19 to the heavy and light chains; FIG. 18). The intensity of binding appeared to reflect the amount of protein expression as was demonstrated on the Western blots (FIG. 14A).

FIGS. 19A-19D depict binding of LY2875358-CD19 fusion proteins described in Example 1 to FMC63 using the same methods as described for the panitumumab-CD19 fusion proteins. As shown in FIG. 20, binding of FMC63 to LY2875358-CD19 fusion proteins was specific when compared to the "mAb only" and "mock Tfx" controls, as described for the panitumumab-CD19 fusion protein example.

This example demonstrates that an anti-CD19 antibody is able to recognize antibody-CD19 fusion proteins. FIG. 21 summarizes expression of, and FMC63 binding to, the antibody-CD19 fusion proteins described in Example 1.

Figure 22:
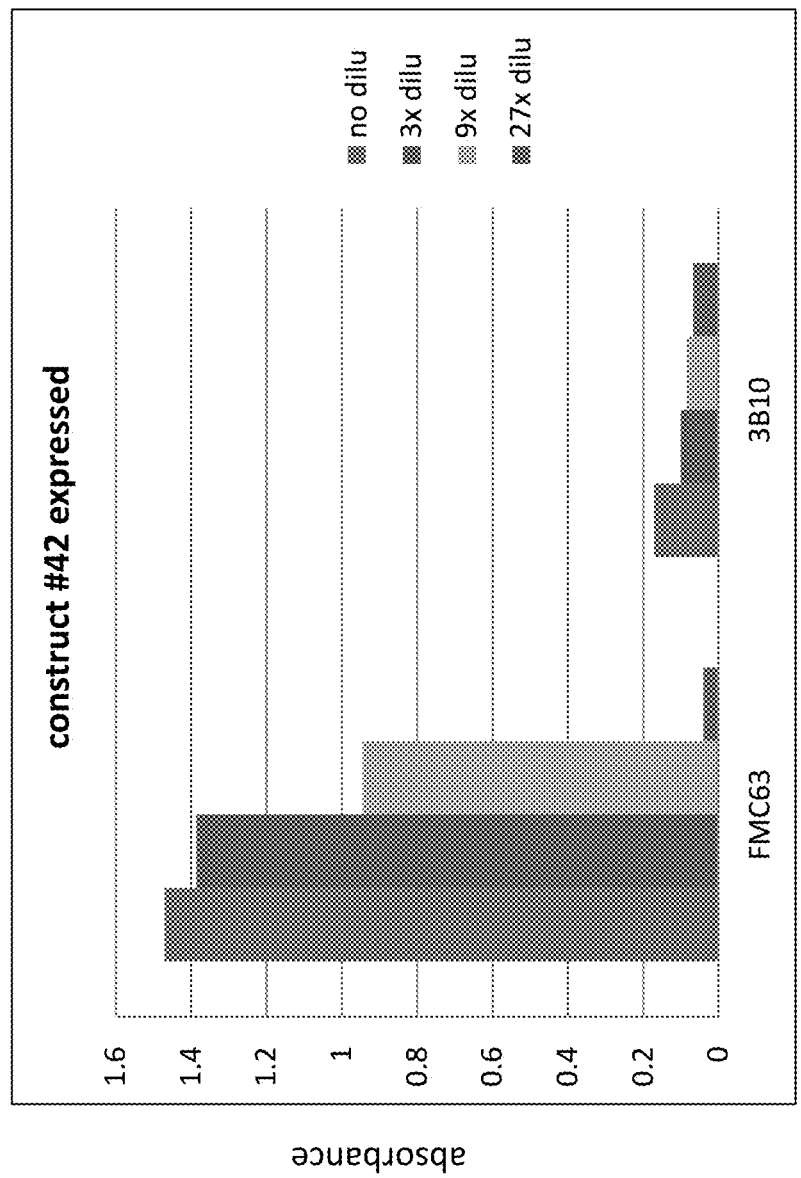
FIG. 22 shows binding of trastuzumab scFv-CD19 fusion proteins to an anti-CD19 antibody (FMC63).

FIG. 22 depicts binding of the CD19-D1+2-Trastuzumab scFv (VH/VL) fusion protein (construct #42 described in Example 1) to an FMC63-coated ELISA plate. The bound scFv-fusion protein was detected with a peroxidase coupled anti-HIS antibody. Note that 3B10, an anti-CD19 mAb that binds to the C-terminus of CD19 (which is lacking in construct #42), did not bind.

Figure 23B:
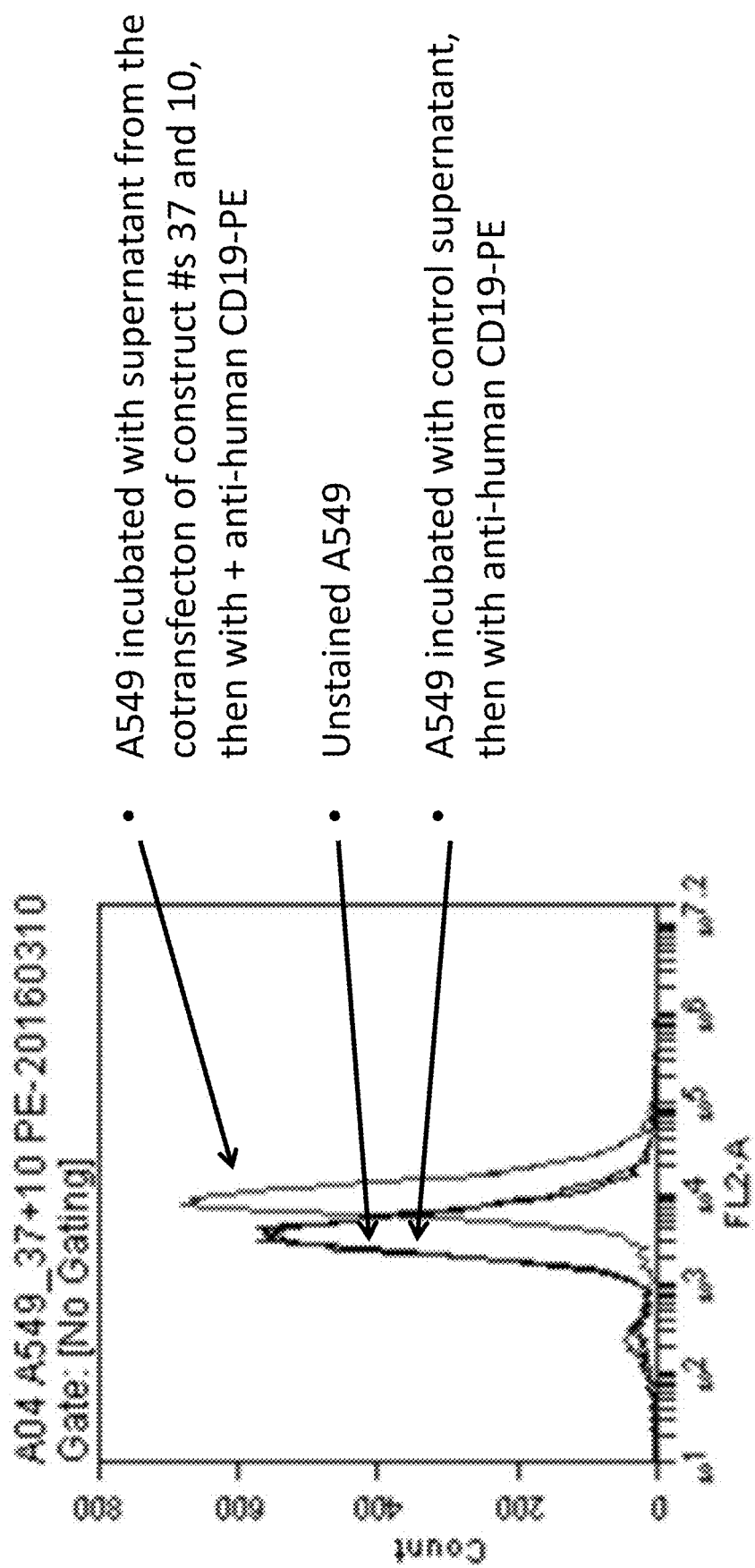
Figure 23C:
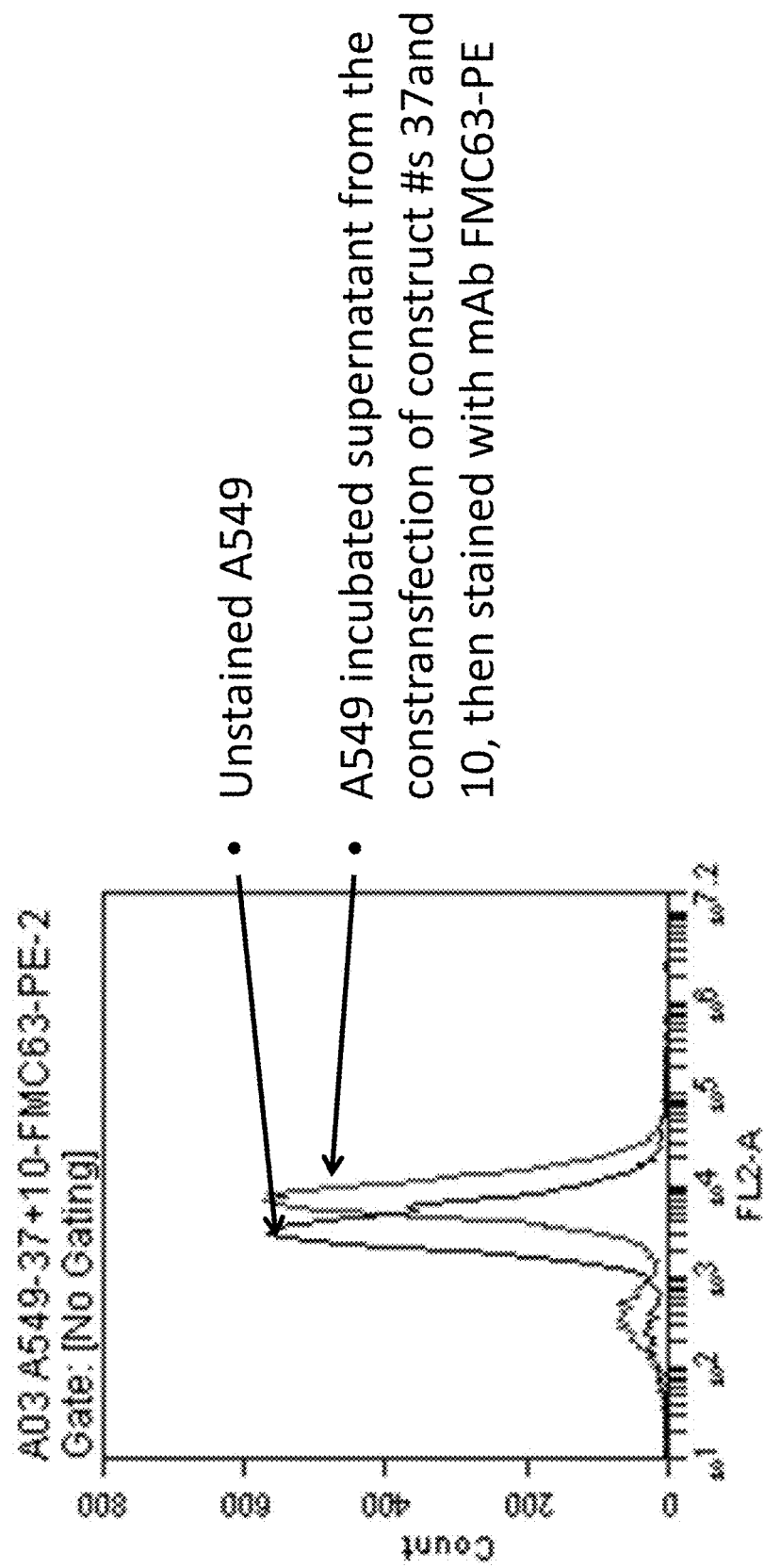

Example 3. LY2875358-CD19 Fusion Proteins Bind to A549 Carcinoma Cells and Bind to Anti-CD19 Antibody The ability of a LY2875358-CD19 fusion protein (construct "37+10" described in Example 1) to bind to A549 carcinoma cells and to FMC63 (anti-CD19 antibody) was tested by Fluorescence Activated Cell Sorting (aka "FACS" or "Flow Cytometry"). A549 cells express the cancer cell-associated protein c-MET that is specifically recognized by LY2875358. The LY2875358 HC (SEQ ID NO:7) and LY2875358 LC (SEQ ID NO:10) were expressed in 293T cells and the cell culture supernatant was incubated with A549 cells. After a 30 minute incubation on ice, the cells were washed with FACS buffer (PBS with 1% BSA and 0.1% sodium azide). The bound antibody was then detected by incubating the cells with an anti-human IgG-Fluorescein Isothiocyanate (FITC) conjugate, which gives off a fluorescent signal when activated by a specific laser in the flow cytometer. The resulting FACS signal can be seen as an increase in mean fluorescence intensity (MFI) detected by the instrument, causing the signal to shift higher (a right-hand shift as depicted in FIG. 23A). A similar shift was detected when the supernatant containing construct "37+10" fusion protein was incubated with A549 cells. Importantly, construct "37+10" fusion protein bound to A549 cells could be detected with the anti-CD19 antibody FMC63, either as a PE-conjugate, where the phycoerythrin (PE) is activated by the Flow Cytometer, or as a purified antibody subsequently bound by an anti-human IgG FITC (FIG. 23B-C). These results show that the LY2875358-CD19 fusion protein bound to the A549 cells by recognition of c-MET by the antibody binding domains, and was recognized in turn by FMC63 anti-CD19 antibody. Thus both the antibody binding domain and CD19 were intact. This example demonstrates that a LY2875358-CD19 fusion protein was able to bind to cells expressing c-MET and to an anti-CD19 antibody.

Figure 24A:
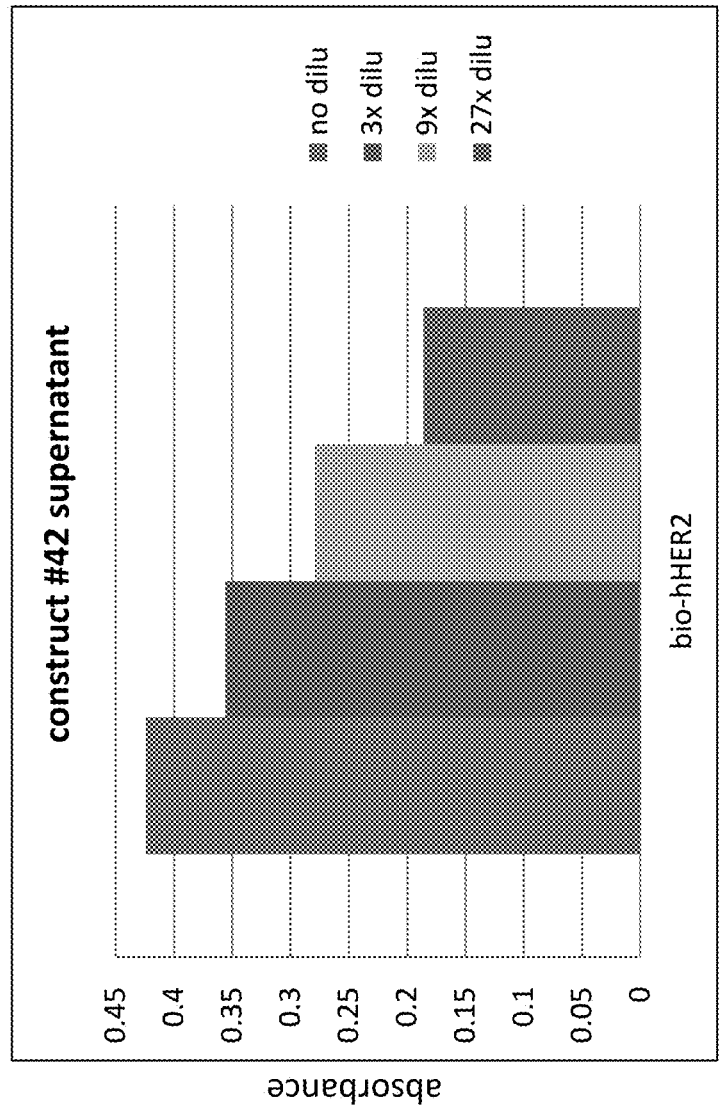
FIGS. 24A and 24B show binding of trastuzumab scFv-CD19 fusion proteins to an anti-CD19 antibody (FMC63) and to Her-2 protein.
Figure 24B:
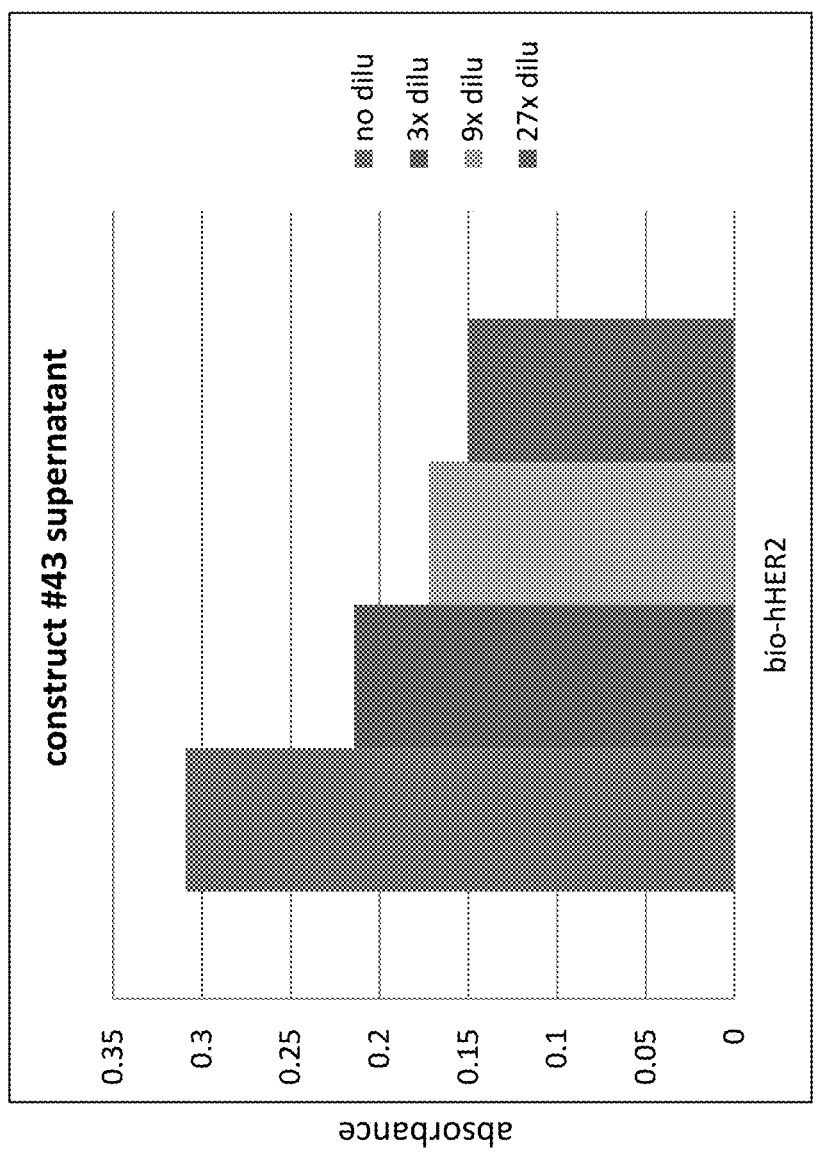
Figure 25A:
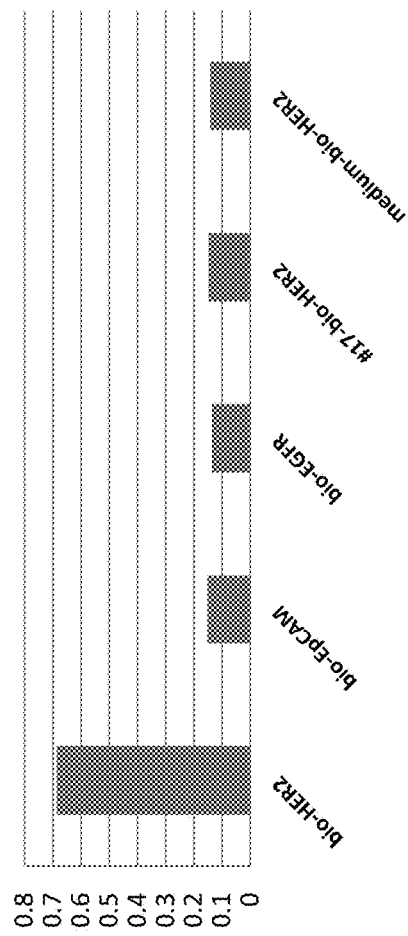
FIGS. 25A and 25B show binding of trastuzumab scFv-CD19 fusion proteins to an anti-CD19 antibody (FMC63) relative to negative controls.
Figure 25B:
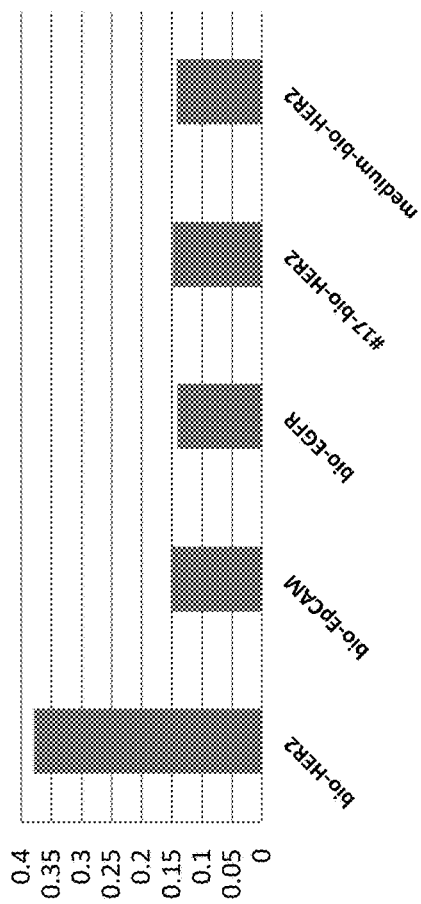

Example 4. Trastuzumab scFv-CD19 Fusion Proteins Bind to Her2 and to Anti-CD19 Antibody The ability of two trastuzumab scFv-CD19 fusion proteins (CD19-D1+2-Trastuzumab scFv (VH/VL); construct #42 described in Example 1; and CD19-D1+2-Trastuzumab scFv (VH/VL)-huIgGFc; construct #43 described in Example 1) to bind to Her2 and to anti-CD19 antibody (FMC63) was determined. ELISA plates were coated with 1 µg/ml FMC63 anti-CD19 antibody and the cell culture supernatant containing HIS tagged construct #42 or Fc-fusion construct #43 was added in different dilutions. After incubation for 1 hour at room temperature and washing, purified biotinylated HER2 protein (ACRO Biosystems) was added at a concentration of 1 µg/ml for an additional hour at room temperature, then the plate was washed again and streptavidin-peroxidase was added to detect the bound biotin conjugated to HER2 (FIG. 24A, B). In a further set of experiments to demonstrate specificity, irrelevant biotinylated proteins were substituted for biotinylated HER2 ("bio-EpCAM", "bio-EGFR"), or the unconjugated form of trastuzumab scFv was used in place of a trastuzumab scFv-CD19 fusion protein ("#17-bio-HER2"), or media alone was added in place of the trastuzumab scFv-CD19 fusion proteins ("medium-bio-HER2"). The results demonstrated the specificity of the binding of biotinylated HER2 to the trastuzumab scFv-CD19 fusion proteins captured on the ELISA plate by anti-CD19 (FIG. 25A, B). As shown in FIG. 24A, construct #42 bound to both FMC63 and to Her2 antigen. FIG. 24B demonstrates that construct #43 fusion protein also bound to both FMC63 and to Her2 antigen. This example demonstrates that trastuzumab scFv-CD19 fusion proteins were able to bind to Her2 antigen and to an anti-CD19 antibody.

Example 5. ELISA Analysis of Various Fusion Proteins

Methods

ELISA was performed on various fusion proteins described below. Briefly, 96 well plates (Pierce, Cat#15041) were coated with 1.0 µg/ml reagent in 0.1 M carbonate, pH 9.5 for O/N at 4C. The plates were then blocked with 0.3% nonfat dry milk (NFD) in TBS (200 µl/well) for 1 hr at RT. Plates were then washed 3× with wash buffer (1×TBST: 0.1 M Tris, 0.5 M NaCl, 0.05% TWEEN® 20). Titrations were performed from undiluted cell culture supernatant or purified protein at 1.0 µg/ml with serial 3× dilutions, 100 µl per well and incubate for 1 h at RT. Dilution buffer is 1% BSA in 1×TBS (0.1 M Tris, 0.5 M NaCl) followed by washing 3× with wash buffer. Secondary reagents were added (if needed) such as Biotinylated-reagents at 1 µg/ml concentration at RT for 1 hour. HRP-conjugated reagents were added at 1:2000, applied 100 µl per well, incubated at RT in dark for 1 hr. 100 µl 1-STEP™ Ultra TMB-ELISA (Thermo Fisher, Prod#34028) was added per well. Plates were read at 405 nm when color had developed.

The following reagents were used:
Human CD19 (20-278) protein, Fc Tag: ACRO Biosystems, Cat# CD9-H5255
Human CD19 (20-291) protein, His Tag: ACRO Biosystems, Cat# CD9-H5226
Anti-CD19 (3B10): NOVUS, Cat# NBP2-46116
Anti-CD19 (MFC63): Millipore, Cat# MAB1794
Human Her2/ErbB2 Protein, Fc Tag: ACRO Biosystems, Cat# HE2-H5253
Human EGF R Protein, Fc Tag: ACRO Biosystems, Cat# EGR-H5252
Human BCMA Protein, Fc Tag: R&D Systems. Cat#193-BC-050
Goat anti-human IgG (H+L) secondary antibody: Thermo Fisher, Cat#31130
6×-His Epitope tag antibody: Thermo Fisher, Cat# PA1-983B
6×-His epitope tag antibody, HRP conjugate: Thermo fisher, Cat# MA 1-21315-HRP
Pierce high Sensitivity Streptavidin-HRP: Thermo Fisher, Cat#21130
Goat anti-Mouse IgG (H+L), HRP conjugated: Jackson ImmunoResearch, Cat#115-035-062
Goat anti-Human IgG (H+L), HRP conjugated: Jackson ImmunoResearch, Cat#109-035-088

The following table lists the various fusion proteins assayed in this Example:

| Construct # | Description | Amino Acid SEQ ID NO: | Nucleotide SEQ ID NO: |
|---|---|---|---|
| 28 | CD19-D1 + 2 | 28 | 228 |
| 29 | CD19-D1 + D2-huIgGFc | 29 | 229 |
| 33 + 4 | CD19-D1 + 2-Panitumumab HC and Panitumumab LC | 33/4 | 233/204 |
| 42 | CD19-D1 + 2-Trastuzumab scFv (VH/VL) | 42 | 242 |
| 43 | CD19-D1 + 2-Trastuzumab scFv (VH/VL)-huIgGFc | 43 | 243 |
| 52 | CD19-ECD-MOC31 scFv (VH/VL) | 52 | 252 |
| 53 | CD19-ECD-LY2875358-scFv (VH/VL) | 53 | 253 |
| 54 | CD19-ECD-Panitumumab scFv (VH/VL) | 54 | 254 |
| 55 | CD19-ECD-Trastuzumab scFv (VH/VL) | 55 | 255 |
| 56 | CD19-ECD-huIgGFc-Trastuzumab scFv (VH/VL) | 56 | 256 |
| 57 | Her2-ECD-Panitumumab scFv (VH/VL) | 57 | 257 |
| 58 | Her2-D4-Panitumumab scFv (VH/VL) | 58 | 258 |
| 63 | CD19-ECD-Leu16 scFv (VH/VL) | 63 | 263 |
| 64 | CD22-D123-FMC63 scFv (VH/VL) | 64 | 264 |

-continued

| Construct # | Description | Amino Acid SEQ ID NO: | Nucleotide SEQ ID NO: |
|---|---|---|---|
| 65 | CD22-D123-Leu16 scFv (VH/VL) | 65 | 265 |
| 67 | CD19-ECD-anti-EGFRvIII scFv (VL/VH) | 67 | 267 |
| 68 | CD22-D123-anti-EGFRvIII scFv (VH/VL) | 68 | 268 |
| 82 | CD19-D1 + 2-Leu16 scFv (VH/VL)-huIgGFc | 82 | 282 |
| 83 | CD19-D1 + 2-Leu16 scFv (VH/VL) | 83 | 283 |
| 89 | C11D5.3 scFv (VL/VH) | 89 | 289 |
| 90 | C11D5.3 scFv (VH/VL) | 90 | 290 |
| 91 | CD19-D1 + 2-C11D5.3 scFv (VL/VH) | 91 | 291 |
| 92 | CD19-D1 + 2-C11D5.3 scFv (VH/VL) | 92 | 292 |
| 93 | CD19-D1 + 2-huIgGFc-Trastuzumab (VH/VL) | 93 | 293 |
| 94 | Bispecific CD19-D1 + D2-Trastuzumab scFv (VH/VL)-Panitumumab scFv (VH/VL) | 94 | 294 |
| 95 | Bispecific CD19-D1 + D2-Trastuzumab scFv (VH/VL)-Panitumumab scFv (VL/VH) | 95 | 295 |
| 96 | Bispecific Trastuzumab scFv-Panitumumab scFv (VH/VL) | 96 | 296 |
| 97 | Bispecific Trastuzumab scFv-Panitumumab scFv (VL/VH) | 97 | 297 |

Results

FIG. 26 shows fusion proteins captured on anti-His antibody-coated ELISA plates. As shown in FIG. 26, the binding capabilities of C-terminal-His-tagged CD19-scFv fusion proteins were demonstrated (FIG. 26, arrows). CD19-ECD-MOC31 scFv (VH/VL) (construct #52) and CD19-ECD-Leu16 scFv (VH/VL) (construct #63) were captured onto the ELISA plate via an antibody directed to the C-terminal His tag. Once bound, the fusion proteins were detected using an HRP-coupled anti-CD19 monoclonal antibody 3B10 that recognizes the CD19 protein. Thus, a positive signal demonstrated that both the C-terminus and N-terminus of the fusion protein were intact and capable of binding.

Figure 27:
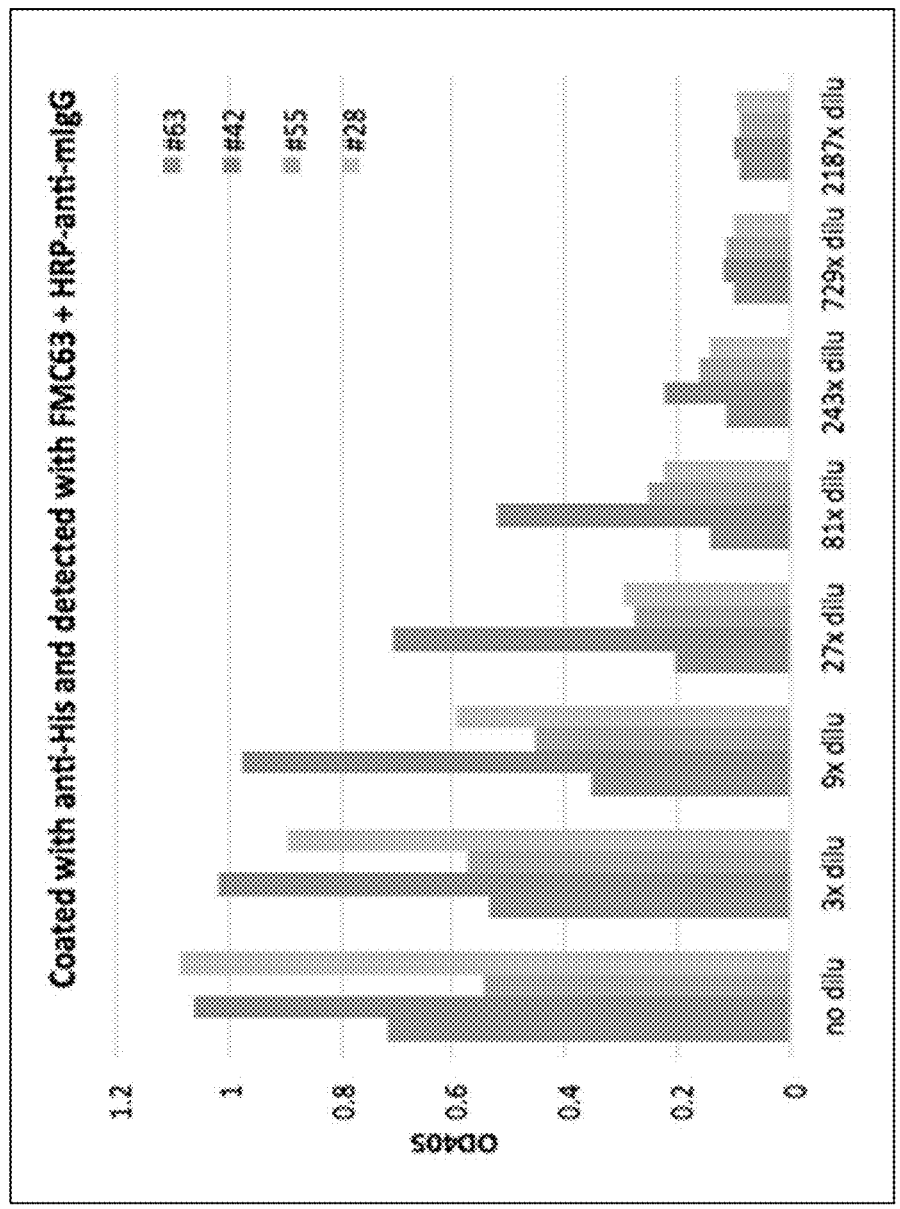
FIG. 27 shows binding of CD19-scFv fusion proteins captured on anti-His antibody-coated ELISA plates.

FIG. 27 shows fusion proteins captured on anti-His antibody-coated ELISA plates. As shown in FIG. 27, the binding capabilities of C-terminal-His-tagged CD19-scFv fusion proteins were demonstrated. A His-tagged CD19 protein (D1+D2; construct #28) was created as a positive control for CD19 recognition. The fusion proteins were captured onto the ELISA plate via an antibody directed to the C-terminal His tag. Once bound, the fusion proteins were detected using the anti-CD19 mouse monoclonal antibody FMC63. Bound FMC63 was detected using an HRP-coupled polyclonal antibody to the murine IgG Fc domain. Thus, a positive signal demonstrated that both the C-terminus and N-terminus of the fusion protein were intact and capable of binding.

Figure 28:
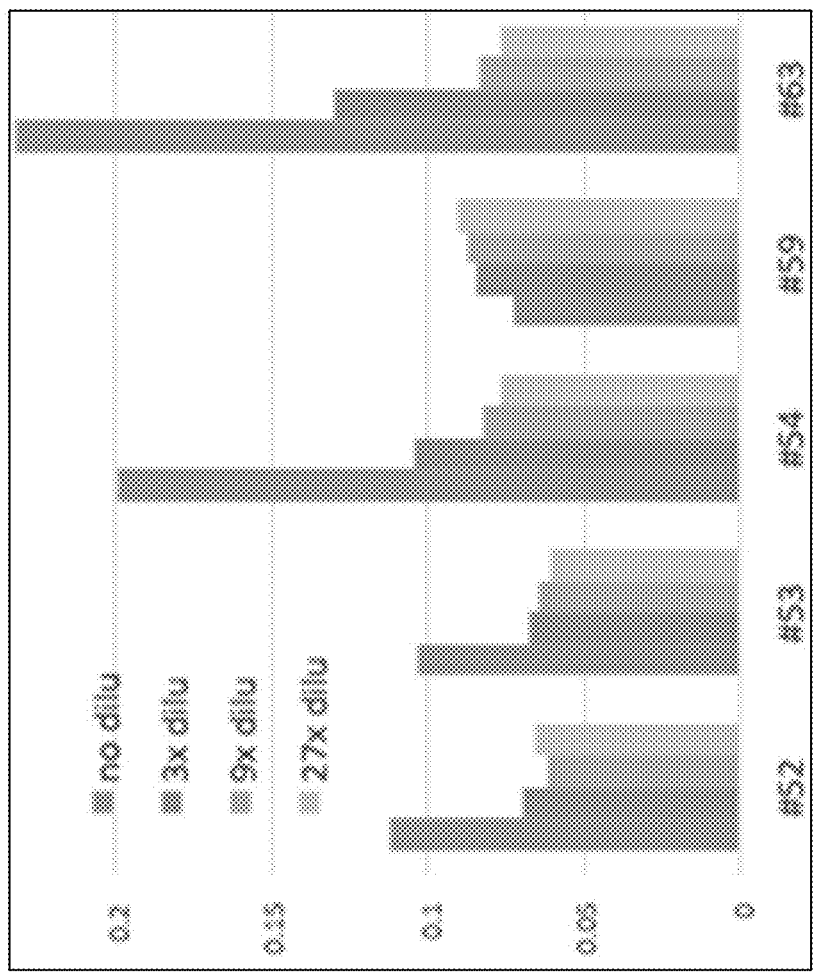
FIG. 28 shows binding of CD19-scFv fusion proteins captured on anti-FMC63 (anti-CD19)-coated plates, then detected with anti-His-HRP.

FIG. 28 shows fusion proteins captured on anti-FMC63 (anti-CD19)-coated plates, then detected with anti-His-HRP. As shown in FIG. 28, the binding capabilities of C-terminal-His-tagged CD19-scFv fusion proteins were demonstrated. The fusion proteins were captured onto the ELISA plate coated with the anti-CD19 mouse monoclonal antibody FMC63. FMC63 captures the fusion proteins by binding the N-terminal CD19 protein. Once bound, the fusion proteins were detected using the HRP-coupled anti-His antibody that recognizes the c-terminal His tag on the fusion proteins. Thus, a positive signal demonstrated that both the C-terminus and N-terminus of the fusion protein were intact and capable of binding.

Figures 65A, 65B:
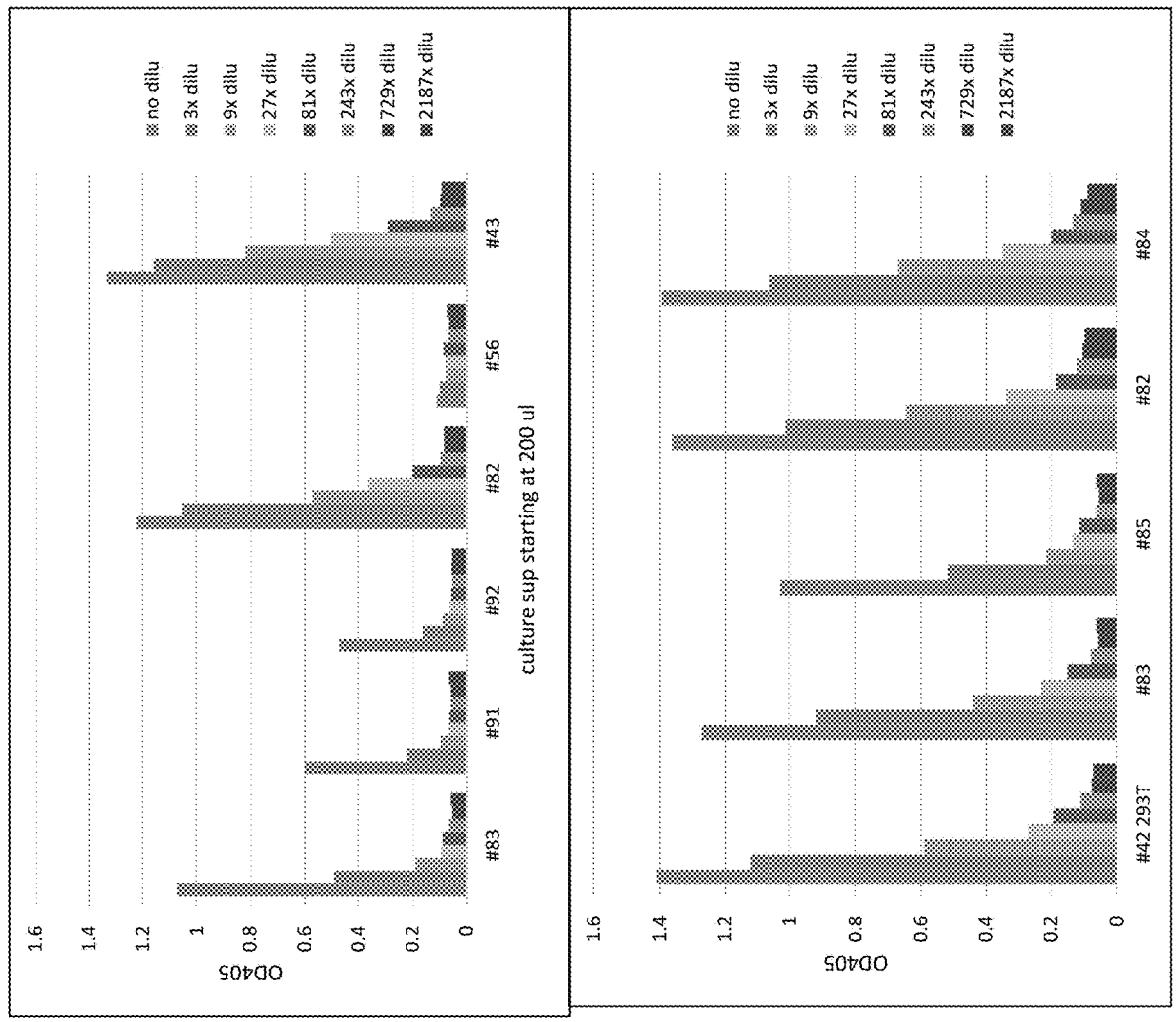
FIGS. 65A-65C depict binding of CD19-containing fusion proteins (#42, #43, #56, #82, #83, #91, #92, #93, #94) to an FMC63-coated plate.
Figure 65D:
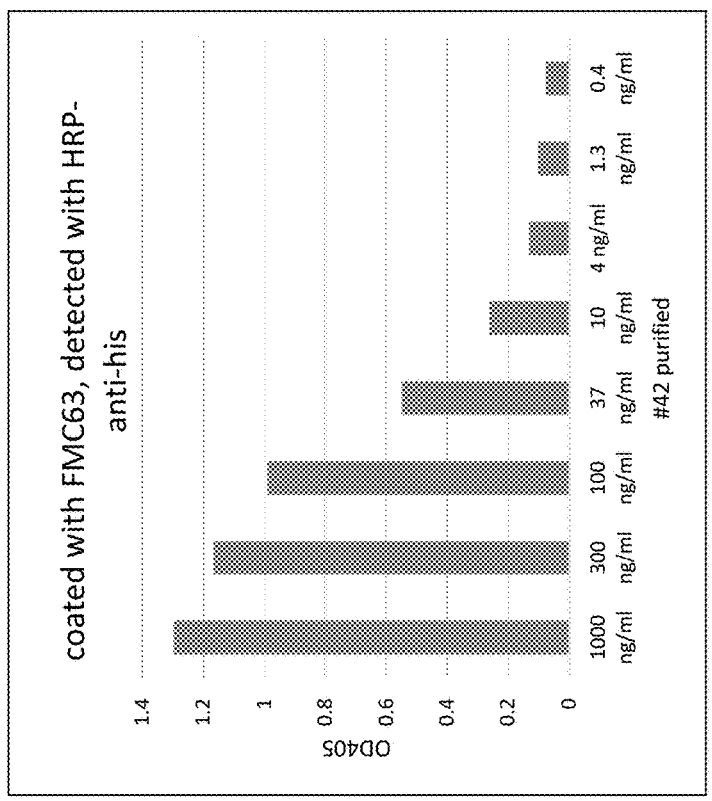
FIG. 65D shows titer determinations for fusion proteins #82, #83, #91, and #92.
Figure 65C:
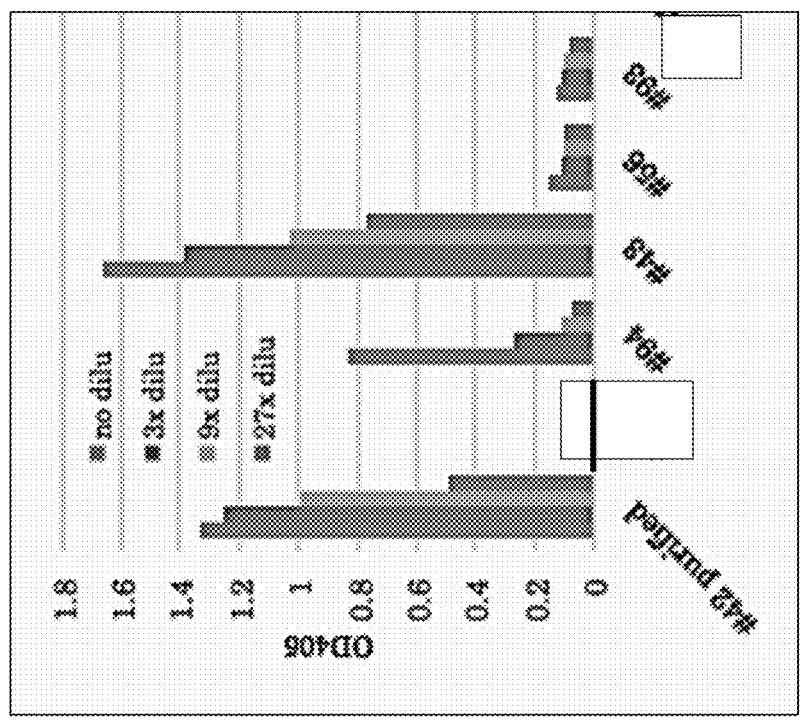
Figure 66A:
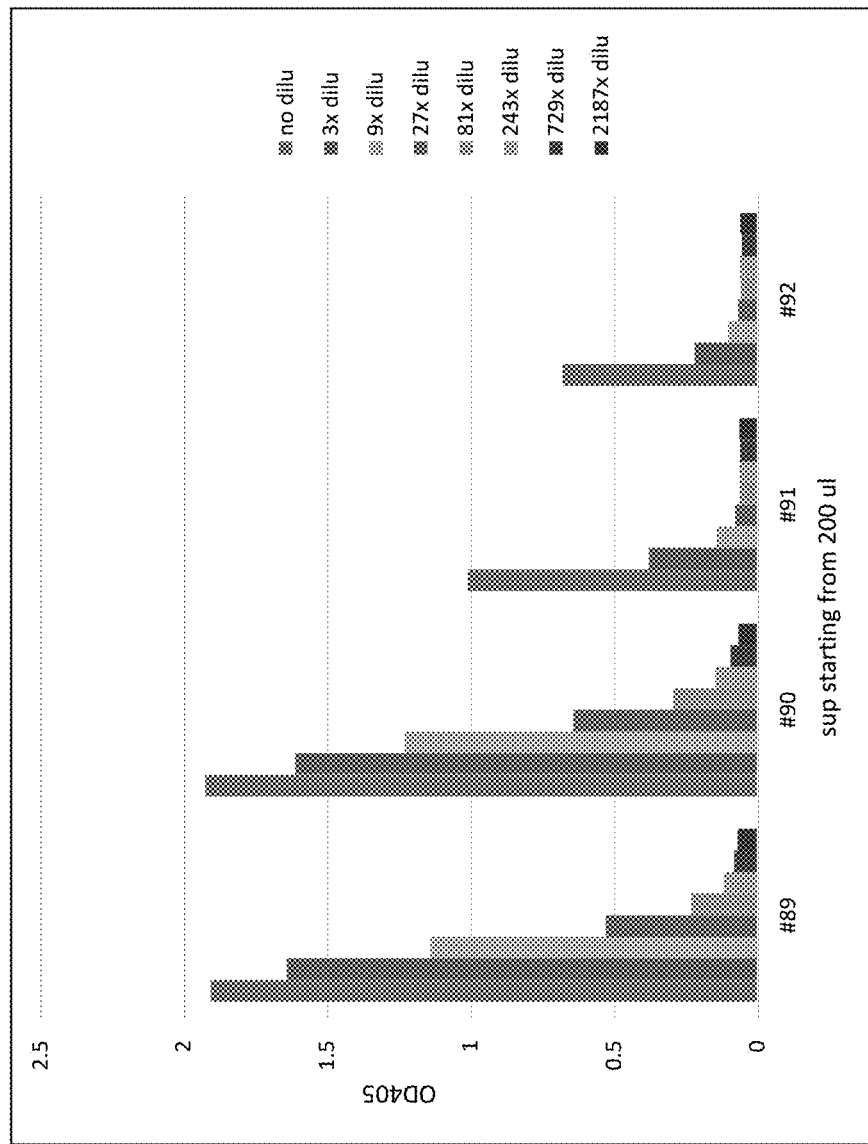
FIGS. 66A-66D show the capture of multiple fusion proteins by plate bound antigen and their detection by anti-His antibody coupled to HRP.
Figure 66B:
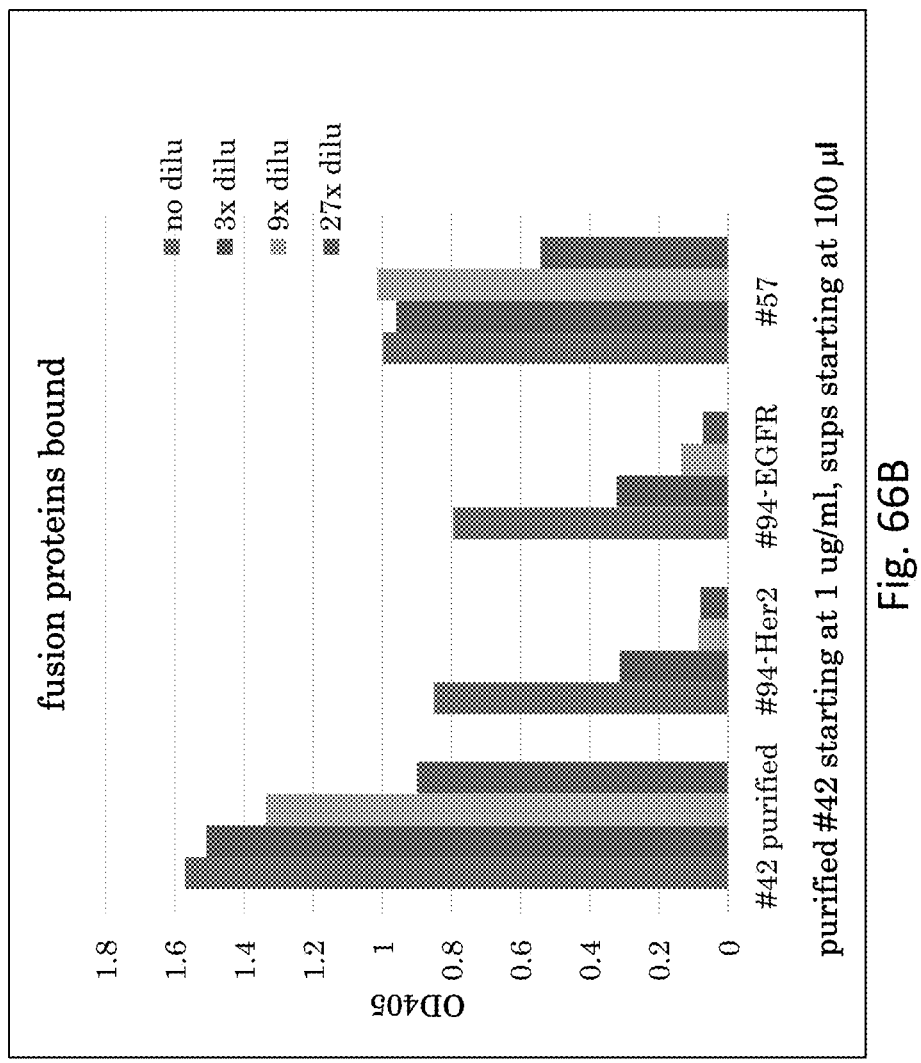
Figure 66D:
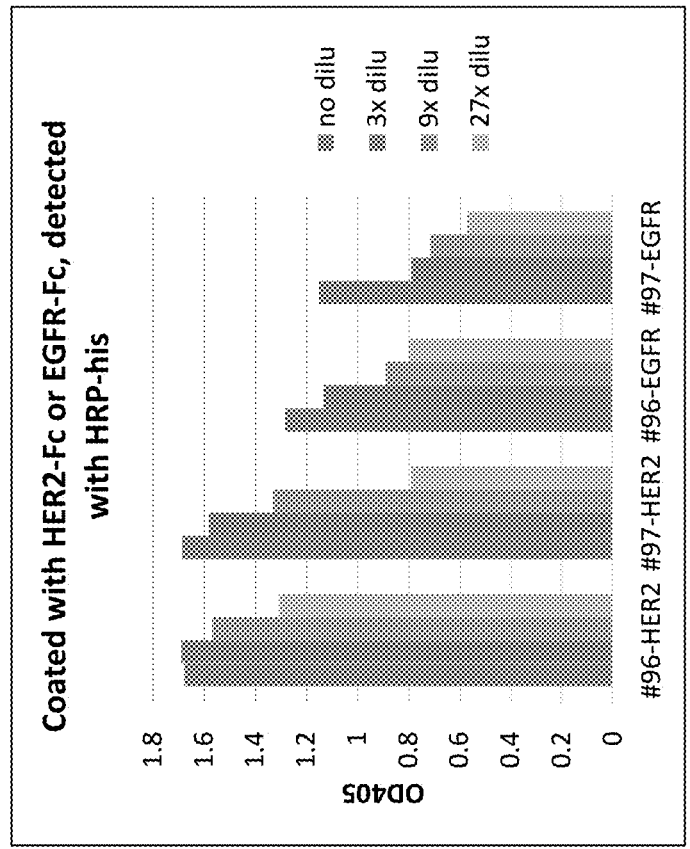
Figure 66C:
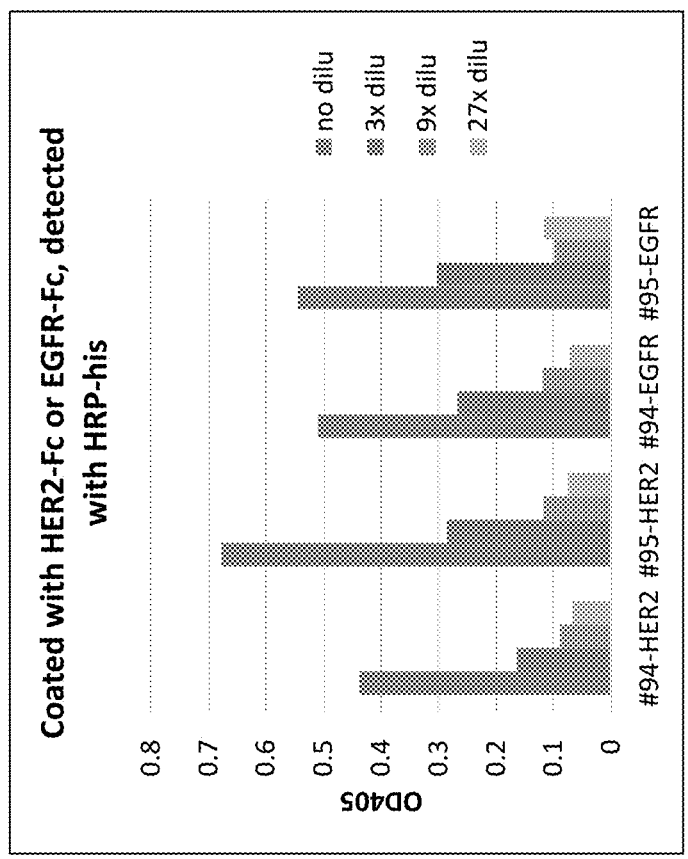

FIGS. 65A, 65B, and 65C depict binding of additional CD19-containing fusion proteins (constructs #42, #43, #56, #82, #83, #91, #92, #93, #94) to an FMC63-coated ELISA plate as described for FIG. 28. The bound fusion proteins were detected with a peroxidase coupled anti-HIS antibody or a peroxidase coupled anti-hIgG antibody. FIG. 65D demonstrates estimates of the fusion protein construct titers by titration against purified construct #42.

FIG. 65C demonstrates that the CD19 bispecific fusion protein (construct #94) was expressed, bound to the anti-CD19 antibody FMC63, and was detected by an anti-His antibody binding to the C-terminal His tag. This indicates that the protein was intact and that the N- and C-termini were present. The controls show strong binding by the fusion protein containing the Trastuzumab scFv only, (construct #42), and by the Trastuzumab scFv-huIgGFc fusion protein (construct #43). Moving the huIgGFc to a position just C-terminal to the CD19 protein domain resulted in fusion proteins with reduced binding to FMC63 mAb (constructs #56 and #93).

Figure 29:
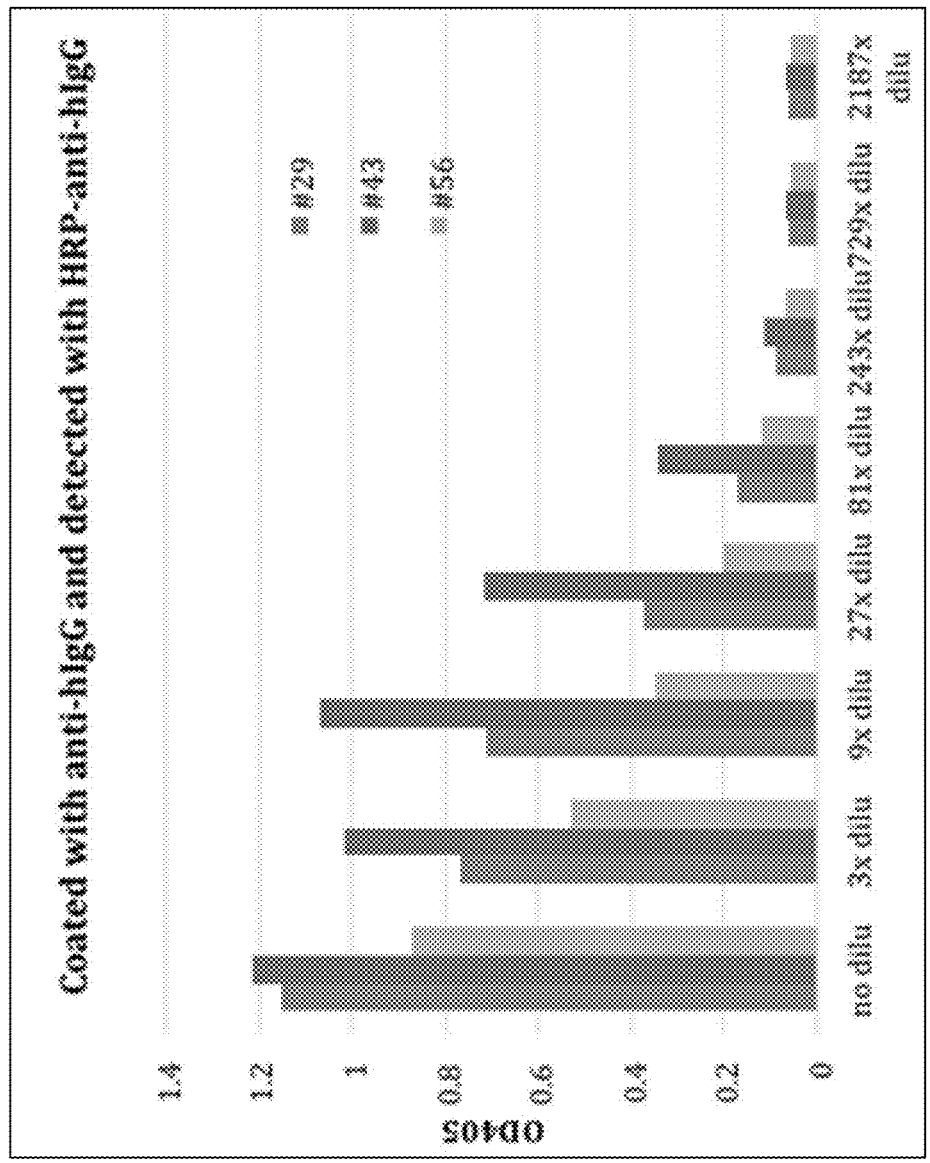
FIG. 29 shows detection of CD19-anti-Her2 trastuzumab scFv-human Fc fusion proteins in a "sandwich ELISA" format.

FIG. 29 shows detection of CD19-anti-Her2 trastuzumab scFv-human Fc fusion proteins (constructs #29, 43, 56) in a "sandwich ELISA" format. The human Fc domain was bound to the plate using a polyclonal anti-human IgGFc polyclonal antibody. Once bound the fusion proteins were detected using a different anti-human IgGFc polyclonal antibody coupled to HRP. The results demonstrated that these fusion proteins were expressed and that the human Fc domain was present.

Figure 31:
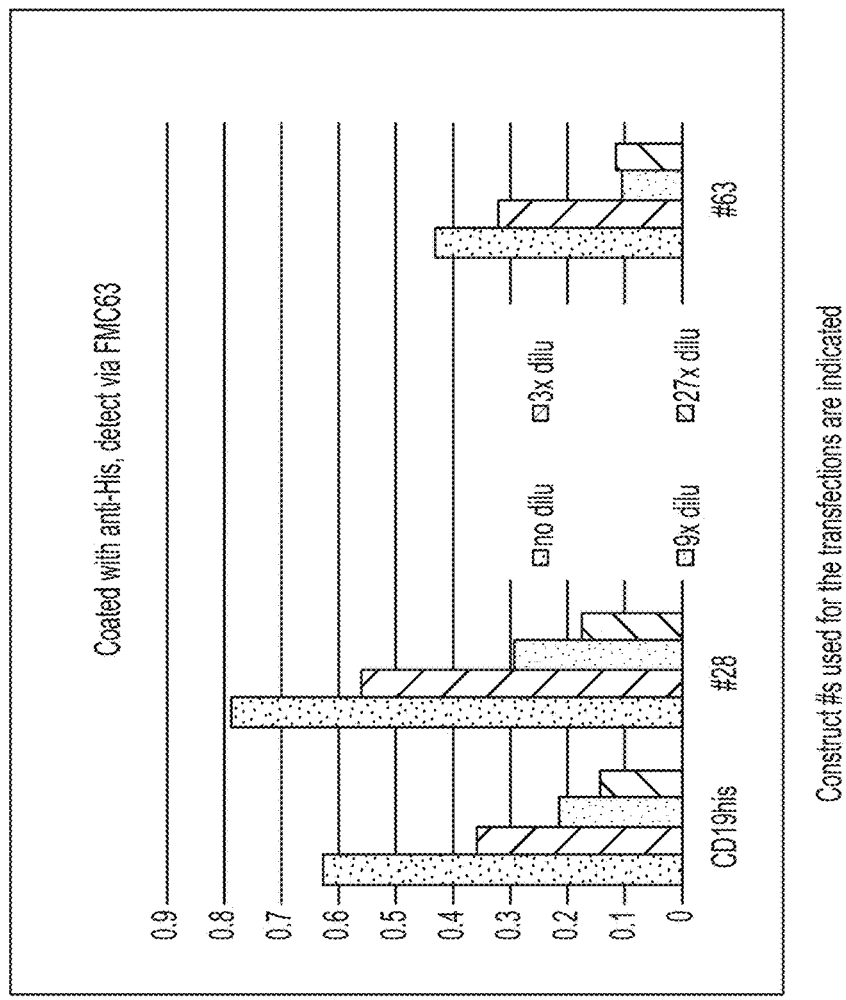
FIG. 31 shows the capture of CD19 full-length extracellular domain-anti-CD20 Leu16 scFv Vh-Vl-His fusion protein by the C-terminal His tag and then detected by mouse monoclonal antibody FMC63 anti-CD19 and then anti-mouse IgG-HRP.
Figure 30:
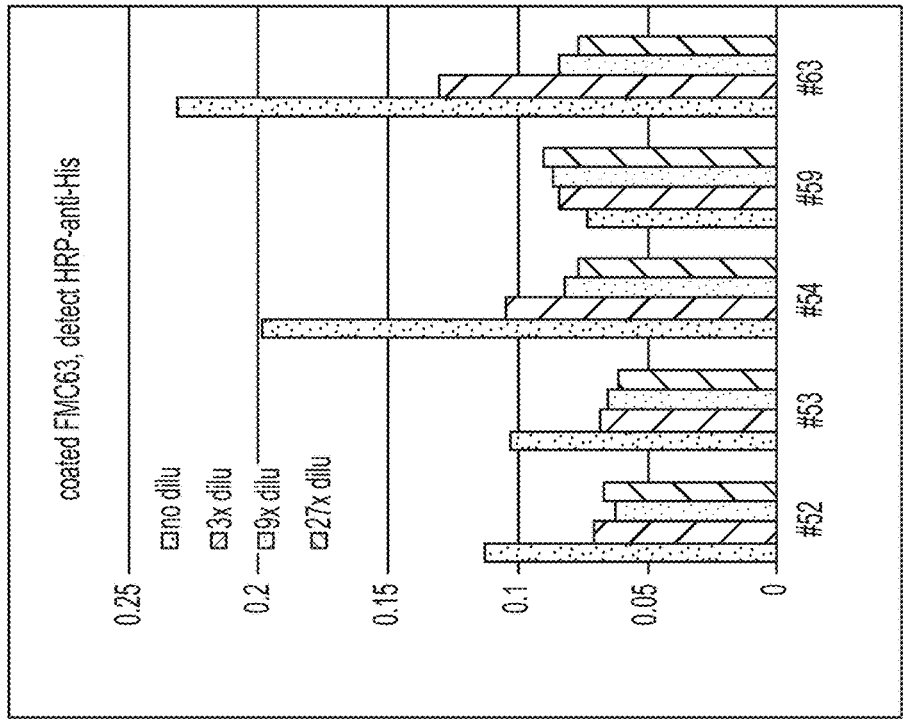
FIG. 30 shows the capture of multiple fusion proteins by anti-CD19 monoclonal antibody FMC63 and their detection by anti-His antibody coupled to HRP.

FIGS. 30 and 31 show fusion proteins detected by various ELISA formats. FIG. 30 shows the capture by anti-CD19 monoclonal antibody FMC63 of multiple fusion proteins (constructs #52, 53, 54, 63) and their detection by anti-His antibody coupled to HRP. In addition, FIG. 31 shows that the CD19-ECD-Leu16 scFv (VH/VL) fusion protein (construct #63) was detected using the reverse format, in which the protein was captured via the C-terminal His tag and then detected by mouse monoclonal antibody FMC63 anti-CD19 and then anti-mouse IgG-HRP. These results demonstrate that the desired binding properties of these fusion proteins were maintained.

Figure 32:
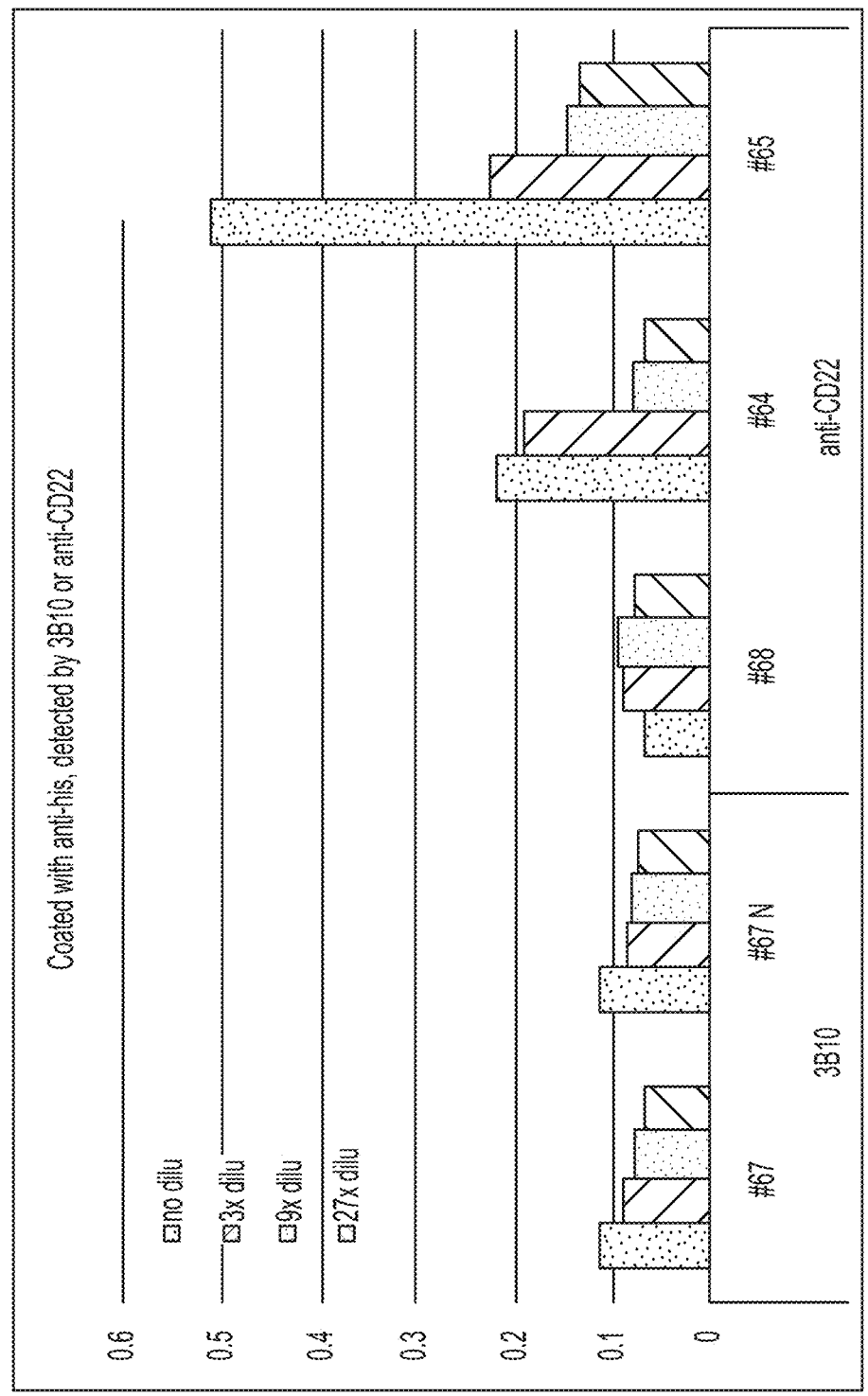
FIG. 32 shows results for fusion proteins that incorporate CD22 protein domains, or anti-EGFRvIII scFv (#64: CD22-FMC63 scFv-His; #65: CD22-anti-CD20 scFv-His; #67: CD19 full ECD-anti-EGFRvIII scFv-his; #68: CD22-anti-EGFRvIII scFv-His).

FIG. 32 shows results for fusion proteins that incorporate CD22 protein domains, or anti-EGFRvIII scFv. FIG. 32 demonstrates that two formats in which a CD22 protein, a truncated and optimized form encoding the first three N-terminal domains of the extracellular portion of the protein and specific mutations, can be fused to scFvs successfully. Constructs #64 and #65 were captured via the C-terminal His tag, and CD22 at the N-terminus was detected. In contrast an identical CD22 protein fused to an anti-EGFRvIII protein was not successfully detected (#68) and neither was a CD19 protein fused to anti-EGFRvIII scFv (#67).

Figure 33:
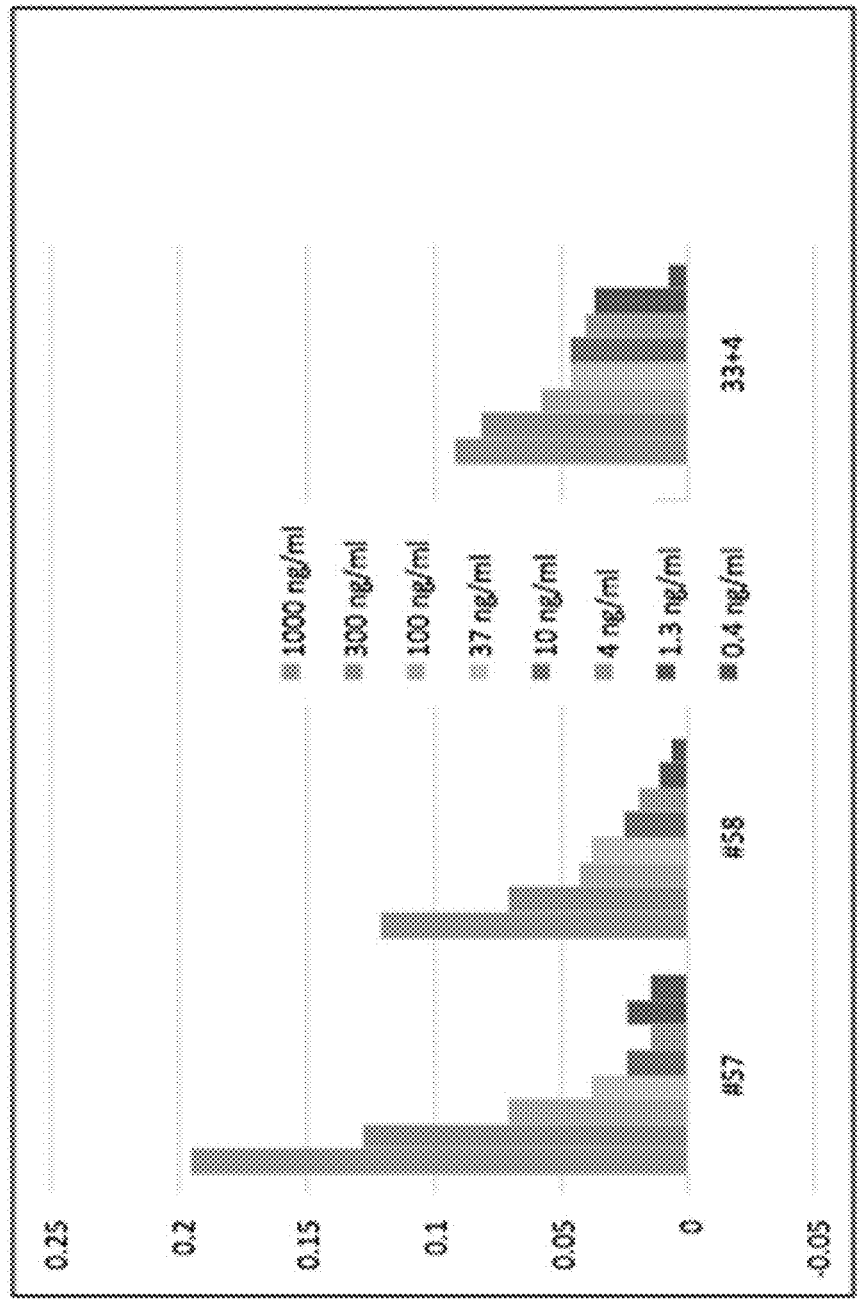
FIG. 33 shows results for protein-antibody fusion proteins and protein-scFv fusion proteins derived from the same antibody, panitumumab (#57: Her2 extracellular domain-Panitumumab scFv Vh-Vl-His; #58 Her2 extracellular D4—Panitumumab scFv Vh-Vl-His; #33+4 (cotransfection of heavy and light chains; one chain carries the CD19 fusion): CD19 extracellular D1+2 Panitumumab antibody—His).

FIG. 33 shows results for a protein-antibody fusion protein (construct "33+4") and protein-scFv fusion proteins (constructs #57 and 58) derived from the same antibody, panitumumab The plate was coated with anti-His antibody, and bound protein was detected with biotinylated-EGFR protein and streptavidin-HRP. FIG. 33 demonstrates that panitumumab and panitumumab-derived scFv fusion proteins were competent to bind their antigenic ligand, EGFR, when bound to the plate by the C-terminal His tag. FIG. 33 also shows that Her2 extracellular domains (full-length or domain 4 (D4)-only) do not disrupt panitumumab and panitumumab-derived scFv binding function. Her2 fusion proteins were similar in this respect to the CD19 fusion proteins.

FIGS. 66A-66D show the capture of various fusion proteins (construct #42, #52, #89, #90, #91, #92, #94, #95, #96, #97) by plate bound antigen and their detection by anti-His antibody coupled to HRP. Human BCMA-Fc (FIG. 66A), Her2-Fc (#42, #94) or EGFR-Fc (#94, #57) (FIG. 66B), and Her-2-Fc or EGFR-Fc, as indicated (FIG. 66D), were bound to the plate using a polyclonal anti-human IgGFc polyclonal antibody. Supernatants generated from transfections with the indicated fusion proteins (purified or expressed) were added to the coated plate and allowed to incubate. After washing, bound protein was detected using a HRP-conjugated anti-HIS antibody. This demonstrates the fusion proteins maintain the ability to bind their respective antigens. Furthermore, fusion protein #94 (FIGS. 66B, 66C) and fusion proteins #95, #96, and #97 (FIGS. 66C-66D), were captured via the encoded scFvs to Her2 and to EGFR, demonstrating that both scFv were functional in the produced fusion protein.

Example 6. Analysis of Target Affinities of Various Fusion Proteins

The binding affinities of the CD19-D1+2-Trastuzumab scFv (VH/VL) fusion protein (construct #42) for binding of the CD19 protein to an anti-CD19 monoclonal antibody and for binding of the Trastuzumab scFv to purified Her2 protein were assessed.

Methods

A 96-well ELISA plate was coated with 2 µg/ml of anti-CD19 monoclonal antibody FMC63 in PBS. The plate was left to incubate overnight at 4° C. The coated plate was washed with PBS then blocked with PBS/0.3% nonfat dry milk (NFD) for 30 minutes at 37° C. The purified CD19-D1+2-Trastuzumab scFv (VH/VL) fusion protein was diluted in PBS/NFD and added at varying amounts from 0.005 µg/ml to 1 µg/ml, covering more than three logs of final concentration. The fusion protein was allowed to incubate for 1 hour at 37° C., then the plate was washed and the HRP-coupled anti-His antibody was added for 30 minutes at 37° C., then used for enzymatic detection, following the manufacturer's directions. The apparent EC50 was calculated using the 4-parameter curve fitting function of Softmax software.

The binding affinity of the FMC63-bound CD19-D1+2-Trastuzumab scFv (VH/VL) fusion protein to Her2 was then assessed. The ELISA plate was coated, washed and incubated with the fusion protein as described above. Then, a titration of purified Her2-Fc was added to the wells and allowed to incubate for 1 hour at 37° C. After a wash with PBS, HRP-coupled anti-hIgGFc antibody was added and incubated for 30 minutes at 37° C. The HRP was detected by enzymatic reaction following the manufacturer's instructions.

The binding affinity for Her2 of the CD19-D1+2-Trastuzumab scFv (VH/VL) fusion protein was also compared to the binding affinity for Her2 of the parental (trastuzumab) scFv (construct #16). The ELISA plate was coated with 2 µg/ml HER2-hFc in PBS overnight at 4° C. The plate was washed with PBS, then blocked with PBS/NFD for 1 hour at 37° C. After another wash with PBS, the proteins or supernatants were added in a titration to the plate and allowed to bind for 1 hour at 37° C. The plate was washed again with PBS, and HRP-coupled anti-His antibody was added for 30 minutes at 37° C., then developed using the manufacturer's instructions. The apparent EC50s were calculated as described above.

Results

Figure 34:
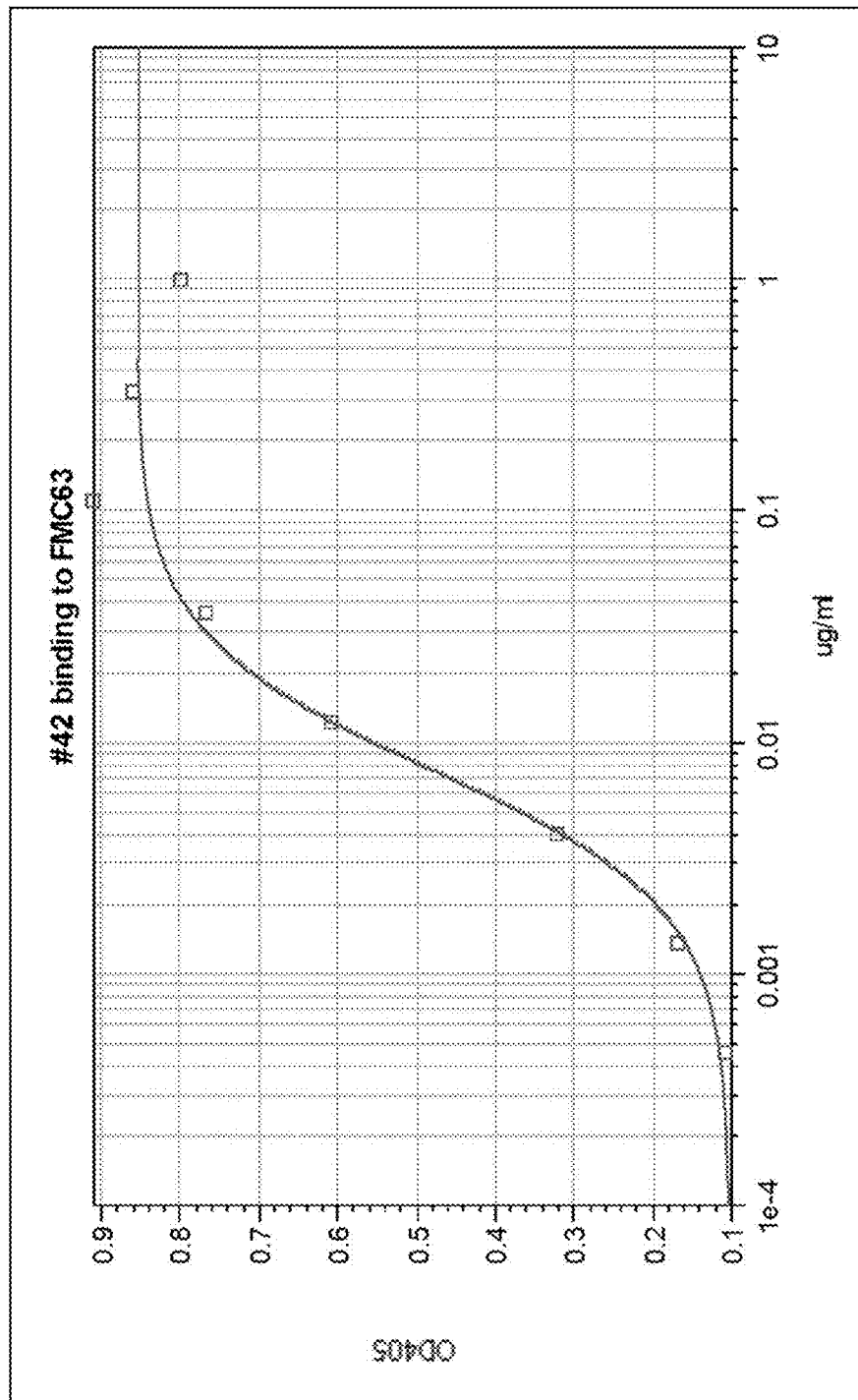
FIG. 34 shows binding affinity of purified CD19-anti-Her2 scFv-His fusion protein for the FMC63 antibody.
Figure 35:
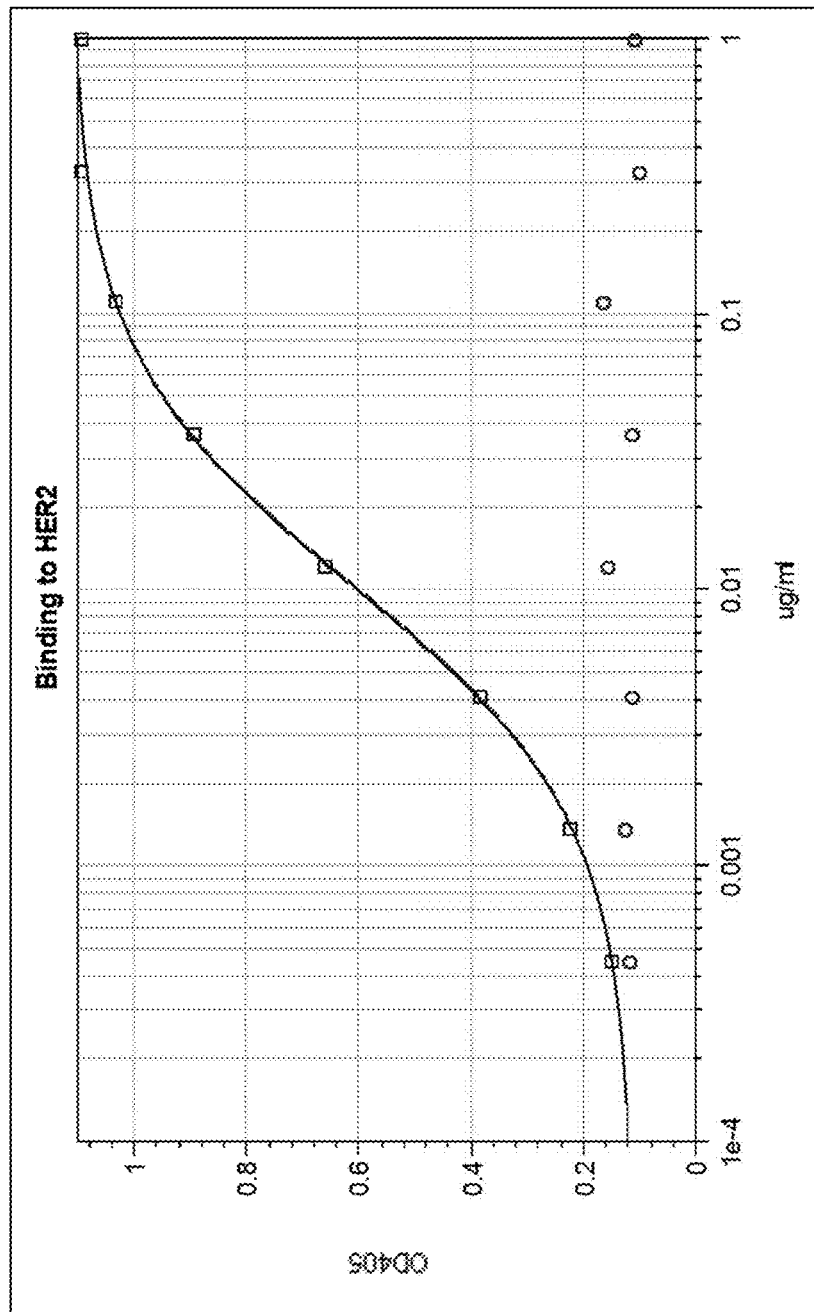
FIG. 35 shows the binding affinity of the FMC63-bound CD19-anti-Her2 scFv-His fusion protein to Her2.
Figure 36:
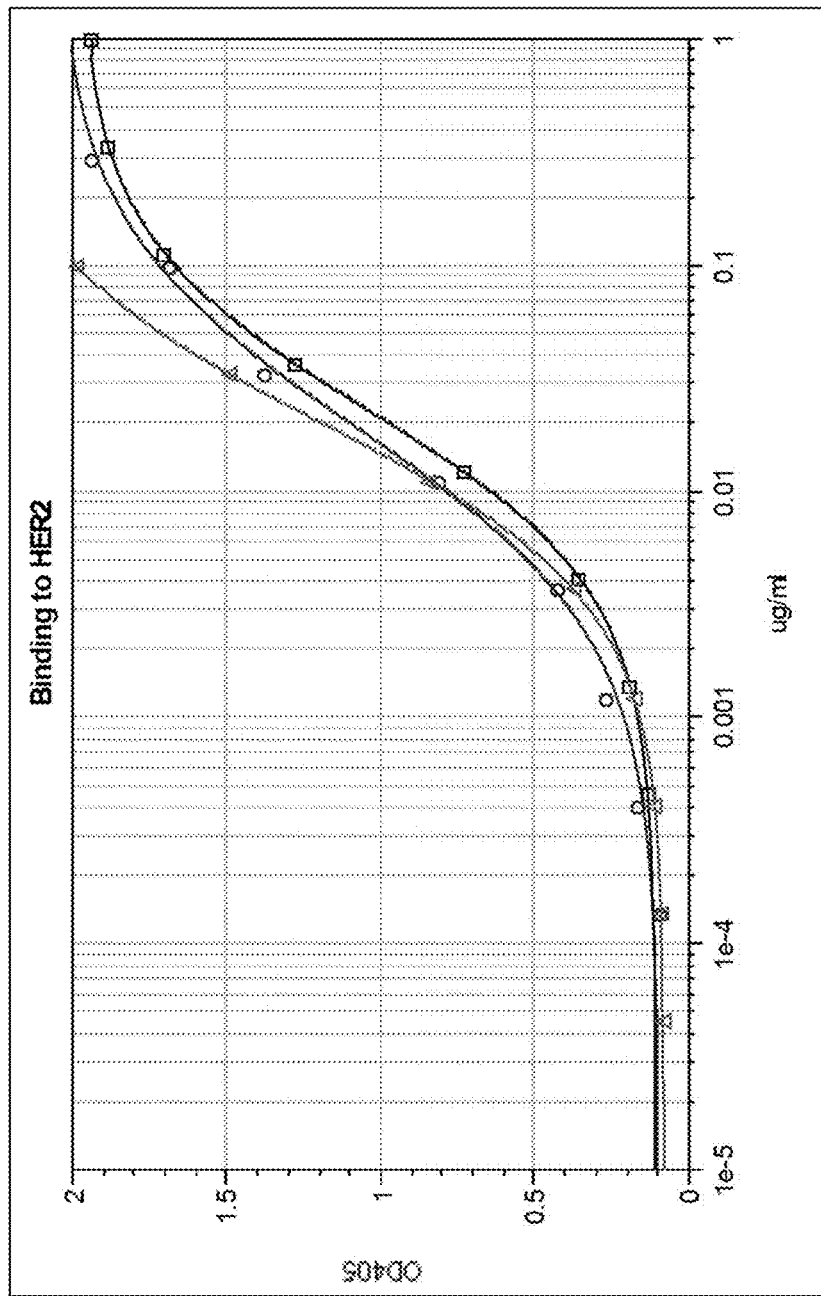
FIG. 36 shows the binding affinity of the FMC63-bound CD19-anti-Her2 scFv-His fusion protein to anti-Her2 scFv.

The purified CD19-D1+2-Trastuzumab scFv (VH/VL) fusion protein bound to the FMC63 antibody with an apparent EC50 of 0.14 nM (FIG. 34), which was very similar to the EC50 of 0.4 nM described for purified CD19 binding to the FMD63-derived CAR construct scFv (Nicholson, I. C. et al. 1998. Mol. Immunol., 34: 1157-1165). The binding affinity of the FMC63-bound CD19-D1+2-Trastuzumab scFv (VH/VL) fusion protein to Her2 was assessed in the ELISA format. As shown in FIG. 35, the apparent affinity in this format was 0.18 nM (the circles show the purified CD19 protein control, which did not bind Her2 and was therefore not detected). The affinity of the scFv in the fusion protein to the expressed anti-Her2 scFv was compared. The apparent affinities of the protein supernatants were very similar for Her2, with the expressed fusion protein binding with an apparent affinity of 0.33 nM compared to the expressed scFv apparent affinity of 0.77 nM (FIG. 36). The affinity of the purified fusion protein was 0.4 nM, showing that purification did not impact the binding capacity of the fusion protein for Her2 (FIG. 36). These affinities are very similar to that published for the trastuzumab scFv (0.3 nM, Zhao et al. 2009 J. Immunol. 183:5563-5574).

Example 7. Analysis of Various Fusion Proteins by Flow Cytometry

Methods

If necessary, cells to be analyzed were detached with 0.5 mM EDTA in PBS followed by washing 2× with ice cold FACS buffer (1% BSA+0.1% Sodium Azide in PBS). Cells were resuspended in FACS buffer ($5 \times 10^5$/100 µl/test). Purified protein (up to 10 µg/ml as the final concentration), or 200 µl supernatant, was added to cells suspended in 100 µl FACS buffer followed by incubation at 4° C. for 30 minutes. After washing 2× with ice cold FACS buffer, cells were resuspended in FACS buffer ($5 \times 10^5$/100 µl/test) and incubated with detection antibody in FACS buffer at 4° C. for 30 minutes. If a secondary antibody was needed, cells were washed and the secondary antibody added at the desired concentration for 30 minutes at 4° C., for the detection step. Samples were then washed 2× with ice cold FACS buffer, cells were fixed with 2% paraformadehyde in PBS, and analyzed on the ACCURI™ Flow Cytometer (BD Biosciences).

Several constructs described in Example 5 were assayed. Additional constructs are listed in the following table:

| Construct # | Description | Amino Acid SEQ ID NO: | Nucleotide SEQ ID NO: |
|---|---|---|---|
| 84 | CD19-D1 + 2-Leu16 scFv (VL/VH)-huIgGFc | 84 | 284 |
| 85 | CD19-D1 + 2-Leu16 scFv (VL/VH) | 85 | 285 |

Results

Figure 37:
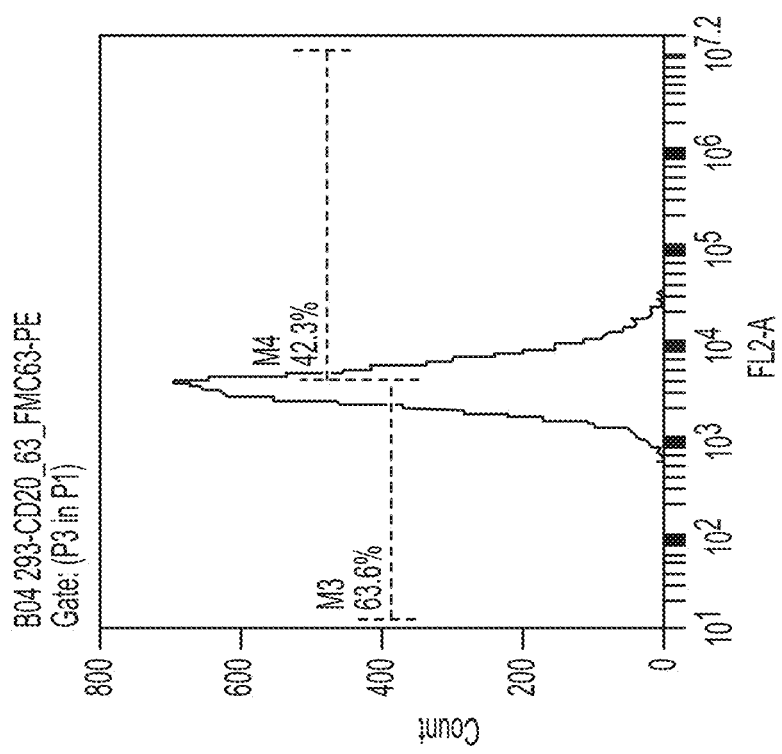
FIG. 37 shows a flow cytometry profile of fusion protein CD19-ECD-Leu16 scFv (VH/VL)(#63) bound to CD20 expressing 293 cells and labeled with anti-CD19 monoclonal antibody FMC63-PE-conjugated.

Stable transfectant line 293-CD20 was incubated with 200 µl fusion protein CD19-ECD-Leu16 scFv (VH/VL) (construct #63) then anti-CD19 monoclonal antibody FMC63-PE-conjugated (aka "293-CD20+#63+FMC63-PE"). As shown in FIG. 37, a small positive shift was observed in the Flow Cytometry (FACS) profile relative to controls.

Figure 38:
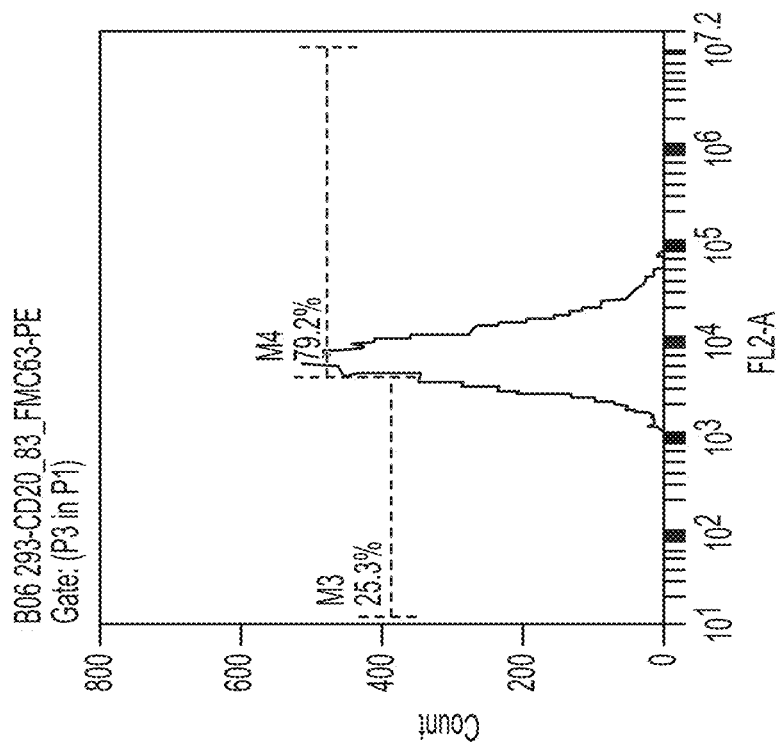
FIG. 38 shows a flow cytometry profile of fusion protein CD19-D1+2-Leu16 scFv (VH/VL) (#83) bound to CD20 expressing 293 cells and labeled with anti-CD19 monoclonal antibody FMC63-PE-conjugated.
Figure 67A:
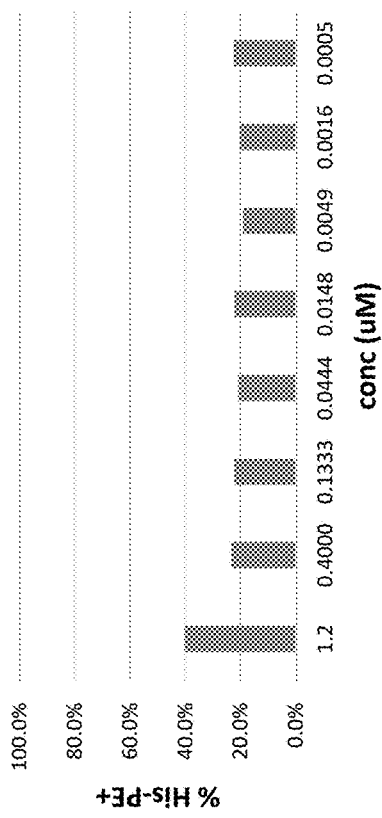
FIGS. 67A and 67B show flow cytometry results of fusion protein CD19-D1+2-Leu16 scFv (VH/VL) (#83) bound to CD20 expressing 293 cells and labeled with anti-His-PE (67A) or anti-CD19 monoclonal antibody FMC63-PE (67B).
Figure 67B:
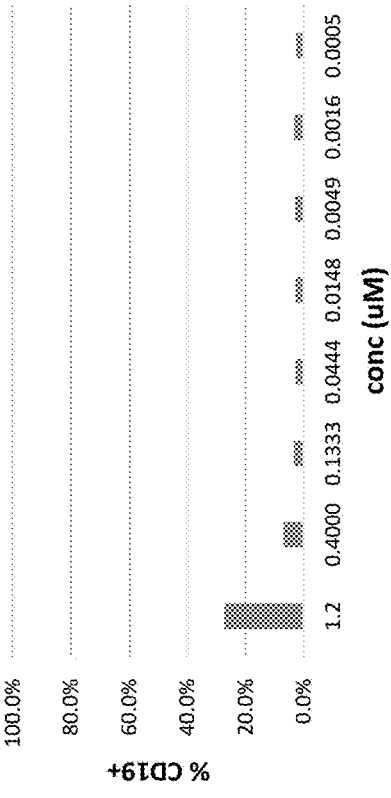

FIG. 38 shows analysis of 293-CD20+200 µl fusion protein CD19-D1+2-Leu16 scFv (VH/VL) (construct #83). FMC63-PE was used to detect the fusion protein bound to the 293-CD20 cells. The results showed a better shift in FACS profile than did #63. This is because the truncated CD19 protein (D1+D2, i.e., exons 1 through 4 encoded, and lacking the last 13 amino acids of the extracellular domain) binds more effectively to FMC63 in this fusion protein format (comparing #63 and #83) than does the full length extracellular domain. Additionally, FIG. 67A shows analysis of varying concentrations of construct #83 bound to 293-CD20 cells detected by α-HIS-PE. FIG. 67B shows analysis of varying concentrations of construct #83 bound to 293-CD20 cells detected by FMC63-PE. These results further support the conclusion that the fusion protein successfully bound to CD20 on the cell surface and presented the CD19 domains to be recognized by the detection antibody.

Figure 39:
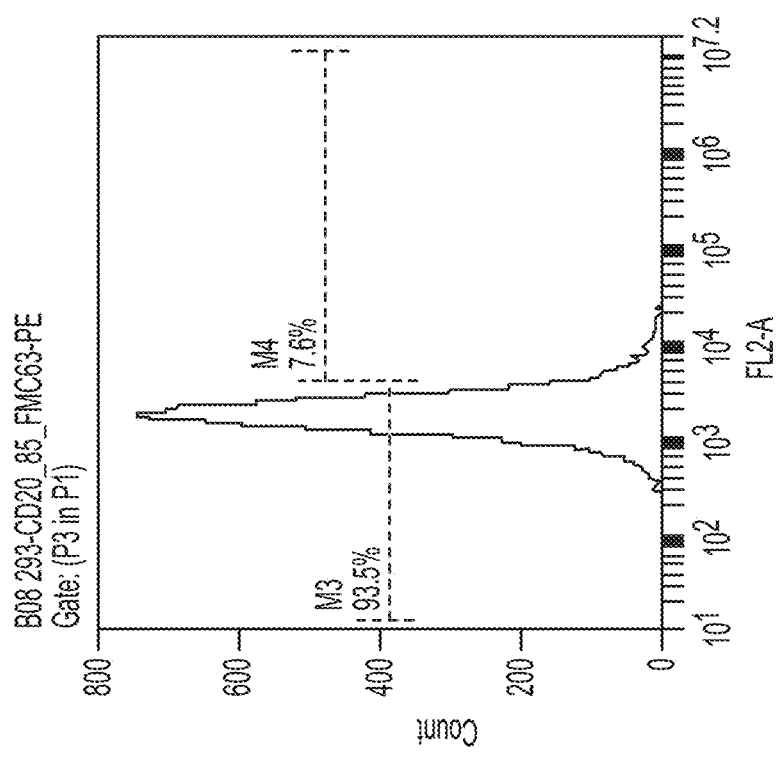
FIG. 39 shows a flow cytometry profile of fusion protein CD19-D1+2-Leu16 scFv (VL/VH) (#85) bound to CD20 expressing 293 cells and labeled with anti-CD19 monoclonal antibody FMC63-PE-conjugated.

FIG. 39 shows analysis of 293-CD20+200 µl fusion protein CD19-D1+2-Leu16 scFv (VL/VH) (construct #85). FMC63-PE was used to detect the fusion protein bound to the 293-CD20 cells. This result showed a fusion protein in which the leu16 scFv was encoded in reverse of #83: thus #85 encodes VL and then VH whereas #83 encodes VH and then VL. The VL-VH leu16 scFv did not bind to the cell, and therefore CD19 (the N-terminal component of the fusion protein) was not detected.

Figure 40:
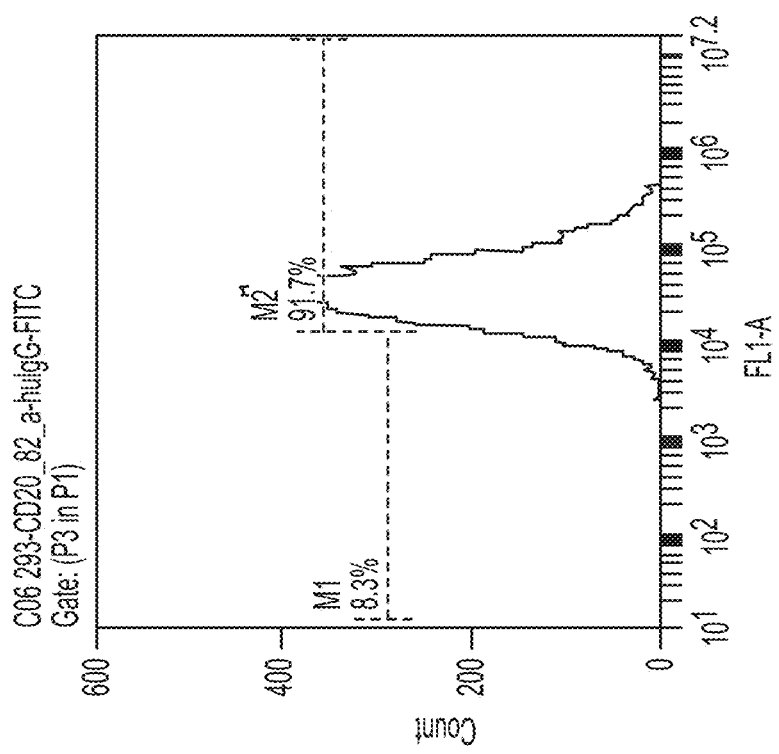
FIG. 40 shows a flow cytometry profile of fusion protein CD19-D1+2-Leu16 scFv (VH/VL)-huIgGFc (#82) bound to CD20 expressing 293 cells+α-huIgG-FITC.
Figure 41:
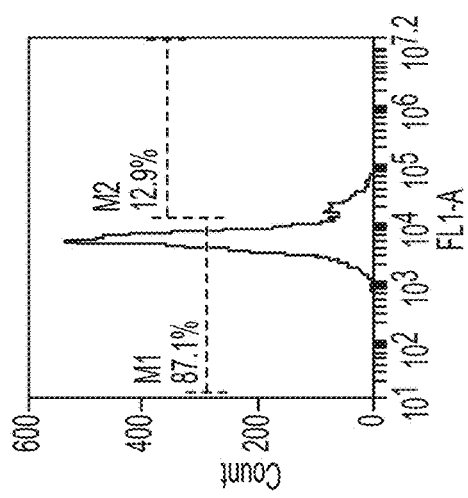
FIG. 41 shows analysis of anti-huIgG-FITC negative control: 293-CD20+α-huIgG-FITC.
Figure 68A:
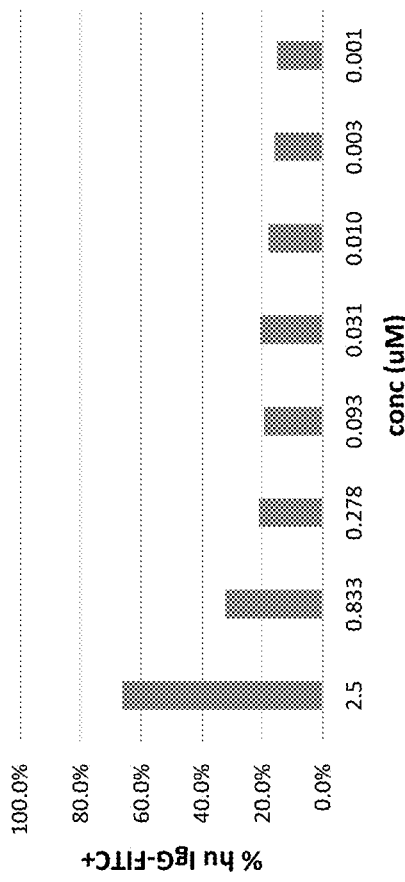
FIGS. 68A and 68B show flow cytometry results of fusion protein CD19-D1+2-Leu16 scFv (VH/VL)-huIgGFc (#82) bound to CD20 expressing 293 cells and labeled with α-huIgG-FITC (68A) or FMC63-PE or anti-CD19 monoclonal antibody FMC63-PE (68B).
Figure 68B:
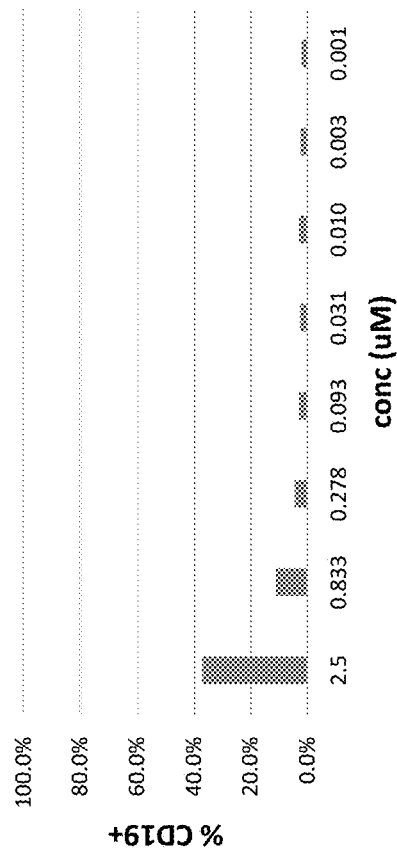

FIG. 40 shows analysis of 293-CD20+200 µl fusion protein CD19-D1+2-Leu16 scFv (VH/VL)-huIgGFc (construct #82). Anti-huIgG-FITC antibody was used to detect the fusion protein bound to the 293-CD20 cells. FIG. 41 shows analysis of anti-huIgG-FITC negative control: 293-CD20 cells+anti-huIgG-FITC antibody (2 µl). This experiment demonstrated that CD19-D1+2-Leu16 scFv (VH/VL)-huIgGFc (FIG. 40) bound at least 1-log over the negative control (FIG. 41) by mean fluorescence intensity (MFI) and that 91.7% of the 293-CD20 cells stained positively in the FACS profile. This demonstrates that the fusion protein that was linked to a human IgG Fc (hinge-CH2-CH3) successfully bound to CD20 on the cell surface and presented the C-terminal human IgGFc domain to be recognized by the detection antibody (anti-human IgG-FITC-conjugated). Additionally, FIG. 68A shows analysis of varying concentrations of construct #82 bound to 293-CD20 cells detected by α-hIgG-FITC. FIG. 68B shows analysis of varying concentrations of construct #82 bound to 293-CD20 cells detected by FMC63-PE. This results further support the result that the fusion protein that was linked to a human IgG Fc (hinge-CH2-CH3) successfully bound to CD20 on the cell surface and presented the C-terminal IgGFc domain to be recognized by the detection antibody.

Figure 42:
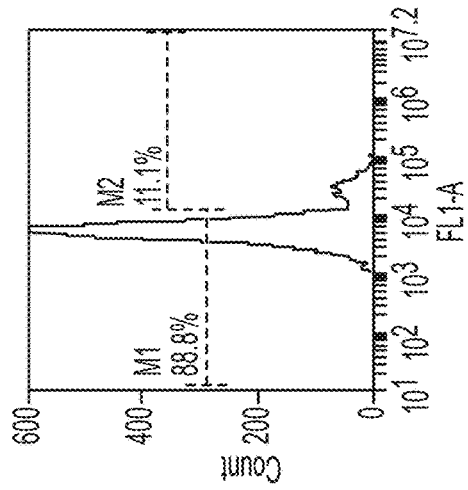
FIG. 42 shows a flow cytometry profile of fusion protein CD19-D1+2-Leu16 scFv (VL/VH)-huIgGFc (#84) bound to CD20 expressing 293 cells+α-huIgG-FITC.

FIG. 42 shows analysis of 293-CD20+200 µl fusion protein CD19-D1+2-Leu16 scFv (VL/VH)-huIgGFc (construct #84). Anti-huIgG-FITC antibody was used to detect the fusion protein bound to the 293-CD20 cells. This experiment showed that, as with the fusion protein of construct #85, the scFv could not be successfully encoded as VL-VH in this fusion protein format.

Figure 43:
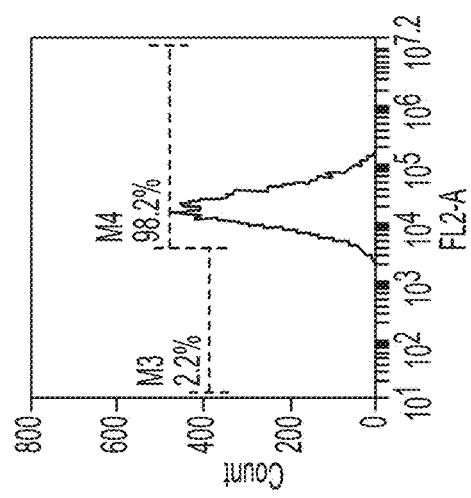
FIG. 43 shows a flow cytometry profile of fusion protein CD22-D123-Leu16 scFv (VH/VL) (#65) bound to CD20 expressing 293 cells+α-His-PE.

FIG. 43 shows analysis of 293-CD20+200 µl fusion protein CD22-D123-Leu16 scFv (VH/VL) (construct #65)+anti-His-PE antibody. FIG. 43 demonstrates that fusion protein CD22-D123-Leu16 scFv (VH/VL), in which the first three domains of CD22 (which were further mutated) were fused to the Leu16 scFv, was detected on the surface of 293-CD20 cells via an antibody to the C-terminal His tag.

Figure 44:
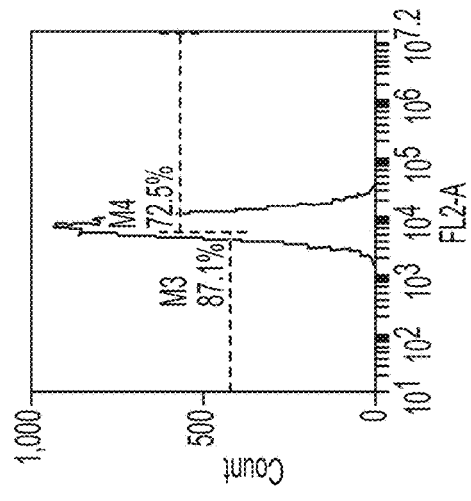
FIG. 44 shows detection control for Her2-A431 cells+Trastuzumab-PE, showing the background level of binding (A431 cells are Her2-negative).
Figure 46:
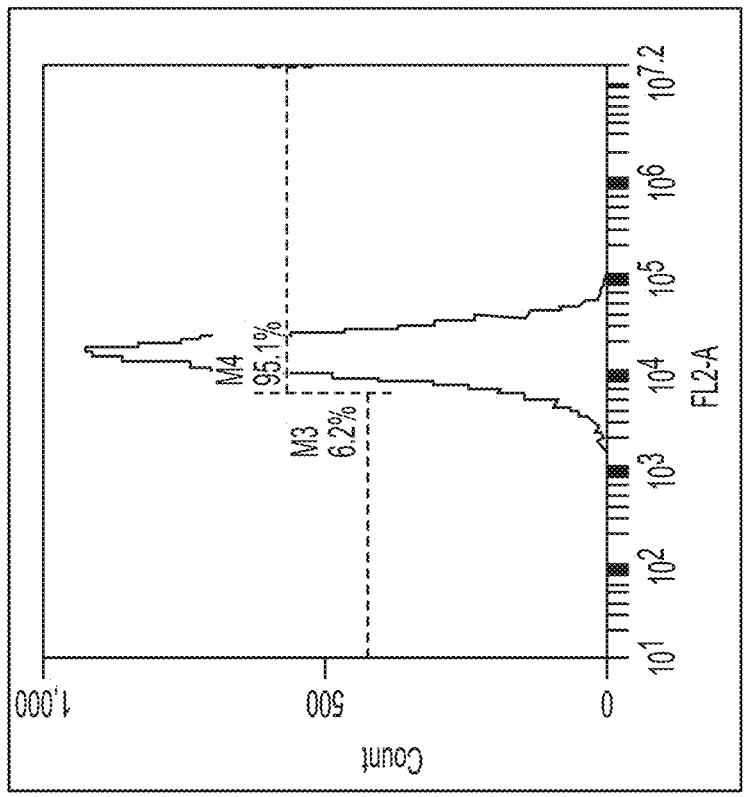
FIG. 46 shows analysis of A431+fusion protein Her2-D4-Panitumumab scFv (VH/VL) (#58)+Trastuzumab-PE-conjugated.
Figure 45:
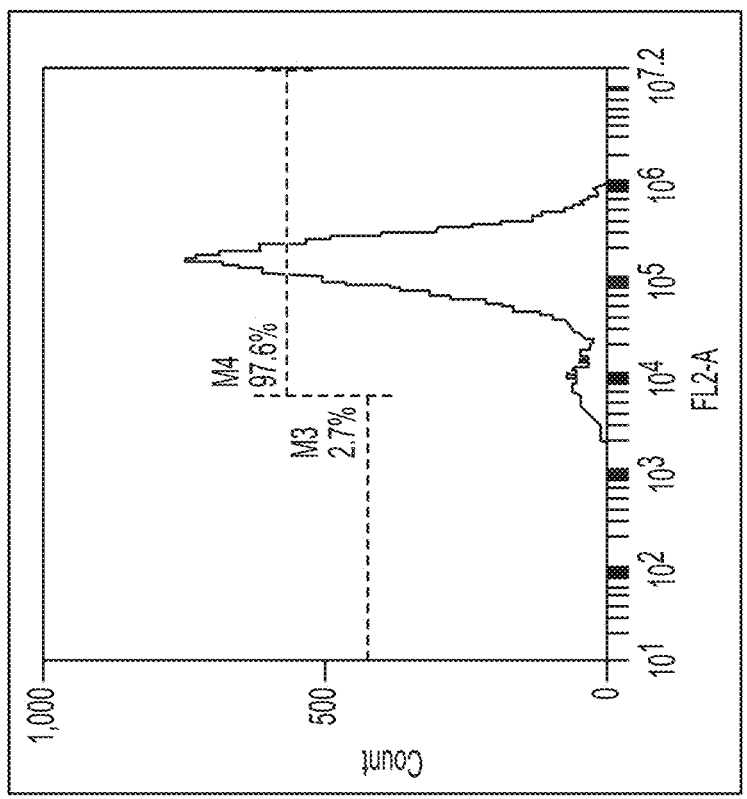
FIG. 45 shows analysis of A431+fusion protein Her2-ECD-Panitumumab scFv (VH/VL) (#57)+Trastuzumab-PE-conjugated.

FIGS. 44-46 demonstrate that a fusion protein bridges trastuzumab to Her2-negative/EGFR-positive cells via EGFR binding by the panitumumab scFv. FIG. 44 shows detection control for Her2-A431 cells+Trastuzumab-PE, showing the background level of binding (A431 cells are Her2-low/negative). FIG. 45 shows analysis of A431+fusion protein Her2-ECD-Panitumumab scFv (VH/VL) (construct #57)+PE-conjugated Trastuzumab. FIG. 46 shows analysis of A431+fusion protein Her2-D4-Panitumumab scFv (VH/VL) (construct #58)+PE-conjugated Trastuzumab. These results demonstrate that the Her2-anti-EGFR scFv fusion proteins bound to an EGFR-positive cell and presented Her2 such that it was, in turn, bound by the anti-Her2 monoclonal antibody trastuzumab.

FIGS. 73-76 further demonstrate that fusion proteins can bridge antigen binding domains with other antigen binding domains. 293T cells were transiently transfected with HER2 or EGFR cDNA expression constructs (GENSCRIPT®) using the Lipofectamine™ 2000 reagent (ThermoFisher), following the manufacturer's instructions. 48 hours post transfection the cells were gently removed from the tissue culture plate using an EDTA solution. After being washed with FACs buffer, the transfected cells were incubated with supernatants containing indicated expressed fusion proteins. All incubations were performed at 4° C. After washing the cells in cold FACs buffer, 2 ug/ml of either HER2-huIgGFc or EGFR-huIgGFc were added and incubated with the cells. The bound fusion proteins were detected with anti-huIgGFc-FITC conjugated antibody (Jackson immunoResearch Laboratories, cat #: 100-096-098) on a flow cytometer (AC-CURI™, BD Biosciences).

Figures 73A, 73B:
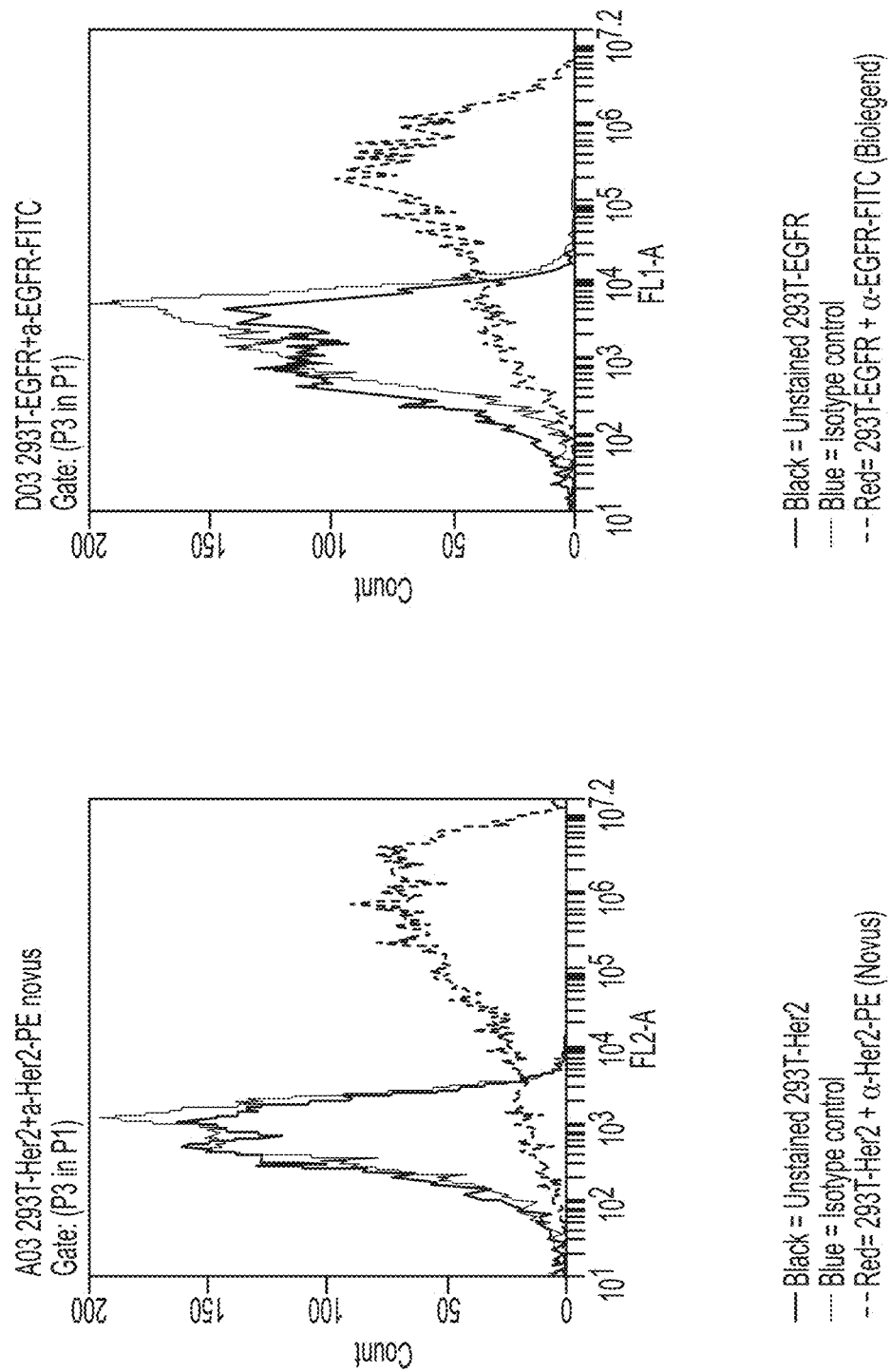
FIGS. 73A and 73B show expression of HER2 and EGFR in transiently transfected 293T cells.
Figure 74A:
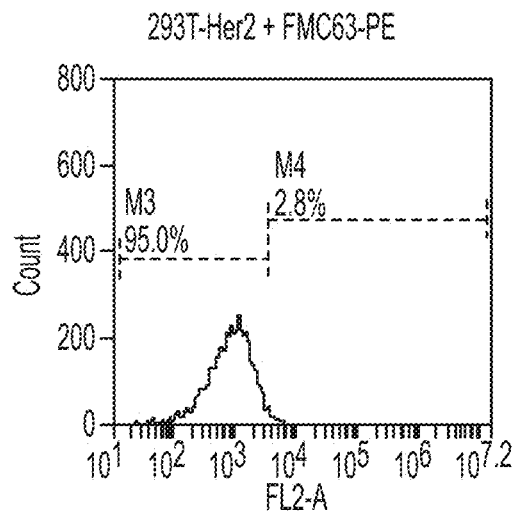
FIGS. 74A-74D show fusion protein #43 binding to 293T-Her2 expressing cells.
Figure 74B:
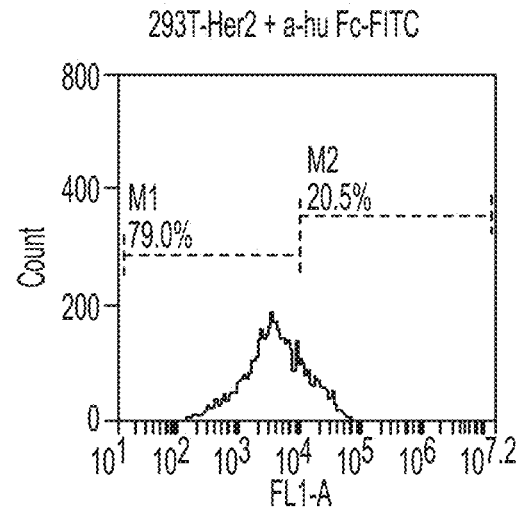
Figure 74C:
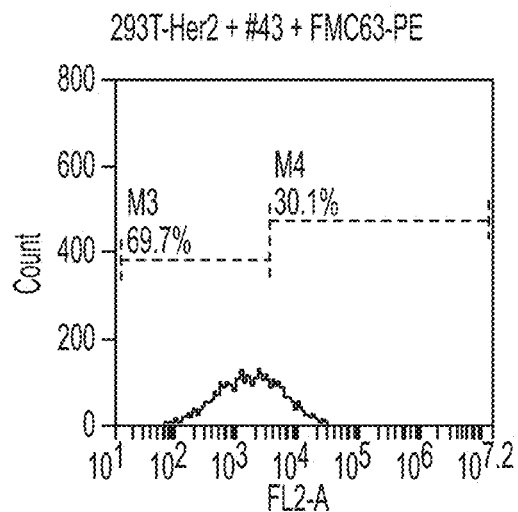
Figure 74D:
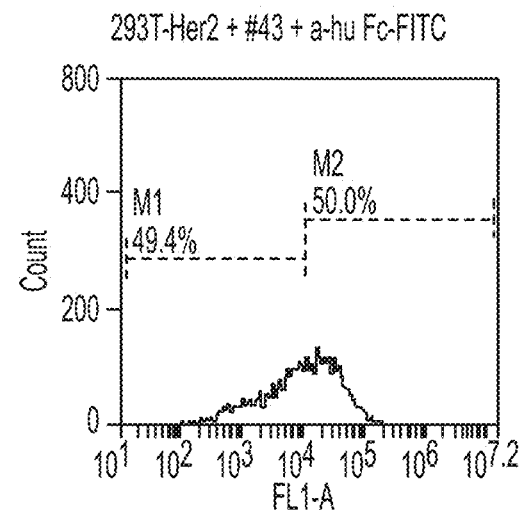
Figure 75A:
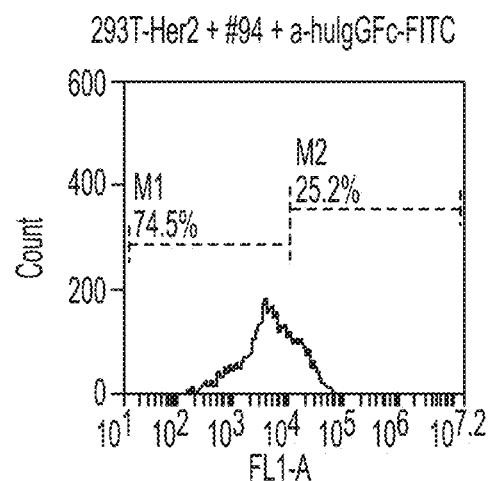
FIGS. 75A-75D show binding of fusion proteins #94, and #95 to 293T-Her2 expressing cells.
Figure 75B:
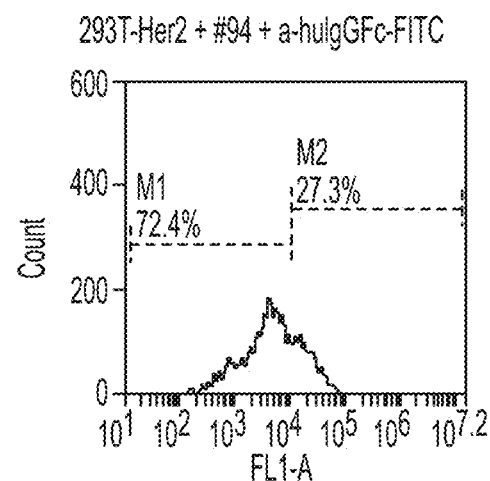
Figure 75C:
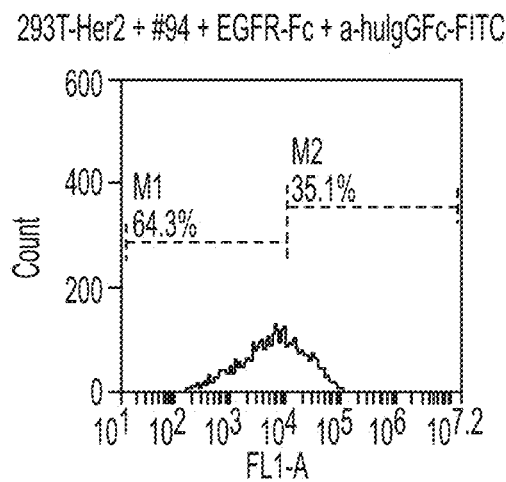
Figure 75D:
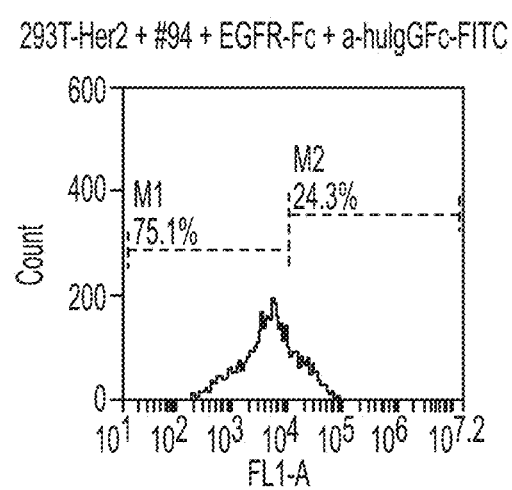
Figure 76A:
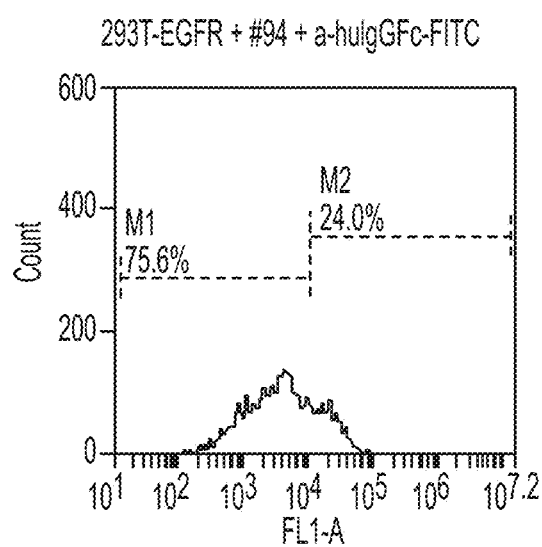
FIGS. 76A and 76B show binding of fusion protein #94 to 293T-EGFR expressing cells.
Figure 76B:
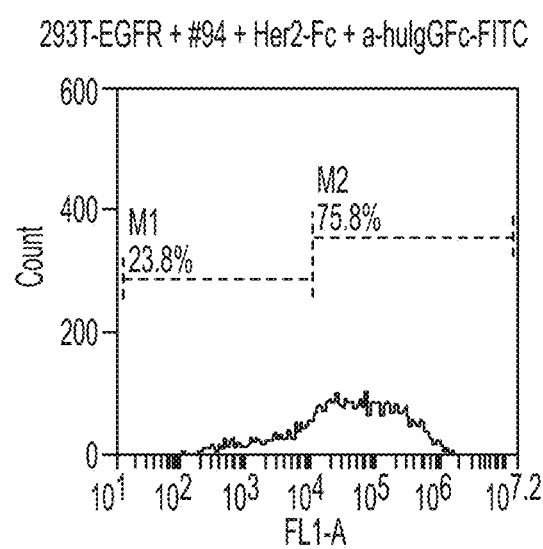

FIGS. 73A and 73B show control samples that were stained with anti-EGFR or anti-HER2 antibodies to confirm expression. FIGS. 74A-74D show the fusion protein expressed by construct #43 binding to 293T-Her2 expressing cells. An increase in signal was noted when either a fluorescently labeled anti-CD19 antibody (FMC63-PE) was present (FIG. 74A vs. 74C) or a fluorescently labeled anti-human IgG-Fc (anti-huIgG-Fc-FITC) (FIG. 74B vs. 74D). FIGS. 75A-75D show binding of construct #94, and #95 to 293T-Her2 expressing cells. An increase in fluorescent signal was noted for fusion protein #94 when recombinant Fc tagged EGFR (EGFR-Fc) was incubated with cells bound to fusion protein #94 demonstrating that both anti-HER2 and anti-EGFR scFv were functional in the expressed fusion protein. In contrast, construct #95, in which the anti-EGFR scFv is included as VL/VH instead of VH/VL, appeared to bind poorly if at all to the HER2-positive cells. FIGS. 76A and 76B demonstrate binding of fusion protein #94 to 293T-EGFR expressing cells as detected via purified soluble HER2-Fc and detection of the huIgG-Fc.

Example 8. CAR19 T Cell Targeting and Activation by Fusion Proteins

The activation and cytotoxicity of CAR19 T cells in the presence of various fusion proteins derived from the expression of specific constructs (described in Example 5) and target cell lines described below was assessed.
Methods
1. CAR19 T Cell Targeting BT474 Cells by Fusion Proteins Binding Her2
BT474 cells were used as Her2 expressing target cells. The following samples, expressed by the indicated constructs, were run in duplicate including:
  BT474+construct #42 fusion protein+CAR-T
  BT474+construct #28 protein+CAR-T
  BT474+CAR-T
  BT474+construct #42 fusion protein or construct #28 protein BT474 only
CAR-T+construct #42 fusion protein or construct #28 protein
CAR-T only On day 1 the tumor cell line BT474 was seeded at $1 \times 10^4$ per well of a flat-bottom 96 well plate (Thermo Fisher, Cat#130188) in cell culture media (RPMI 1640, 10% FBS). One plate was seeded for 24 hour culture and analysis and a second plate for 48 hour culture and analysis. On day 2, the fusion protein of construct #42 (described in Example 5) or control protein (construct #28 described in Example 5) were added at 0.5 µg/well where indicated, then left to incubate at 37° C. for 1 hour using the cell culture incubator.

CAR-CD19-directed-T cells (from Promab) were freshly thawed from pre-aliquoted vials kept in liquid nitrogen and washed once with medium to remove DMSO. The CAR19 T cells were then added to the 96 well plate where indicated, using a T cell:target cell (aka effector:target) cell ratio of 10:1 or 1:1, where the target was the BT474 cells.

On day 3, the 24 hour culture plate was harvested for analysis. The cell culture supernatant was removed and frozen at −20° C. for later Interferon gamma measurement. The plates were gently washed ×2 with RPMI 1640, then 100 µl media was added to each well before performing the XTT cytotoxicity assay. On day 4, the 48 hour culture plate was harvested for analysis using the exact same procedure as used for the 24 hour plate.

XTT Cell Proliferation Assay (ATCC, Cat#30-1011K)

An aliquot of the XTT reagent and the activation reagent was rapidly thawed at 37° C. prior to use. 0.1 ml of activation reagent was then added to 5.0 ml of the XTT reagent. 50 µl of the activated −XTT solution was then added to each well. The plate was placed in the cell culture incubator for 2-4 hours and monitored for color development. The absorbance of the plate was read at wavelength 450 nm. The % cell death (aka cytotoxicity) was calculated as follows:

% killing=[1−OD(experimental wells−corresponding number of T cells)/OD (tumor cells without T cell-medium)]×100

Interferon Gamma Concentration Assay by ELISA

A 96 well plate (Pierce, product #15041) was coated with 1.0 µg/ml mouse anti-human IFNγ (BD Pharmingen, Cat#551221) in 0.1 M carbonate buffer, pH 9.5, overnight at 4° C. The plate was blocked with 0.3% non-fat dry milk solution in tris-buffered saline (TBS) using 200 µl/well for 1 hour at room temperature. The plate was washed ×3 with wash buffer (1× TBS/TWEEN®: 0.1 M Tris, 0.5 M NaCl, 0.05% TWEEN® 20). 100 µl culture supernatant from the 24 hour or 48 hour culture plates (see above) were added to the ELISA plate. A titration of recombinant human IFNγ (Thermo Fisher, Cat# RIFNG100) was also performed in the same plate from 300 ng/ml with serial 3× dilutions to 2 pg/ml to generate a standard curve. The plate was then incubated for 1 hour at room temperature. The dilution buffer was 1×TBS (0.1 M Tris, 0.5 M NaCl) plus 1% BSA. The plate was washed ×3 with wash buffer. Biotinylated mouse anti-human IFNγ (BD Pharmingen, Cat#554550) was added at 1 µg/ml concentration and the plate was incubated at room temperature for 1 hour. The plate was washed again ×3 with wash buffer. HRP-conjugated Streptavidin (Thermo Fisher, Cat#21130) was added at a 1:2000 dilution from the stock, with 100 µl added per well. The plate was then incubated at room temperature for 1 hour in the dark. The plate was washed again ×3 with wash buffer. 100 µl per well of 1-STEP™ Ultra TMB-ELISA development solution (Thermo Fisher, Cat #34028) was added per well. The plate was read at wavelength 405 nm when color developed sufficiently.

2. Analysis of CAR19 T Cell Targeting 293-CD20 Cells by Fusion Proteins Binding CD20

293 cells expressing CD20 were used as target cells and were assayed using the same XTT assay described above.

3. Analysis of CAR19 T Cell Targeting A431 Cells by Fusion Proteins Binding EGFR A431 cells were used as EGFR expressing target cells and were assayed using the same XTT assay described above.

Results

Figure 47:
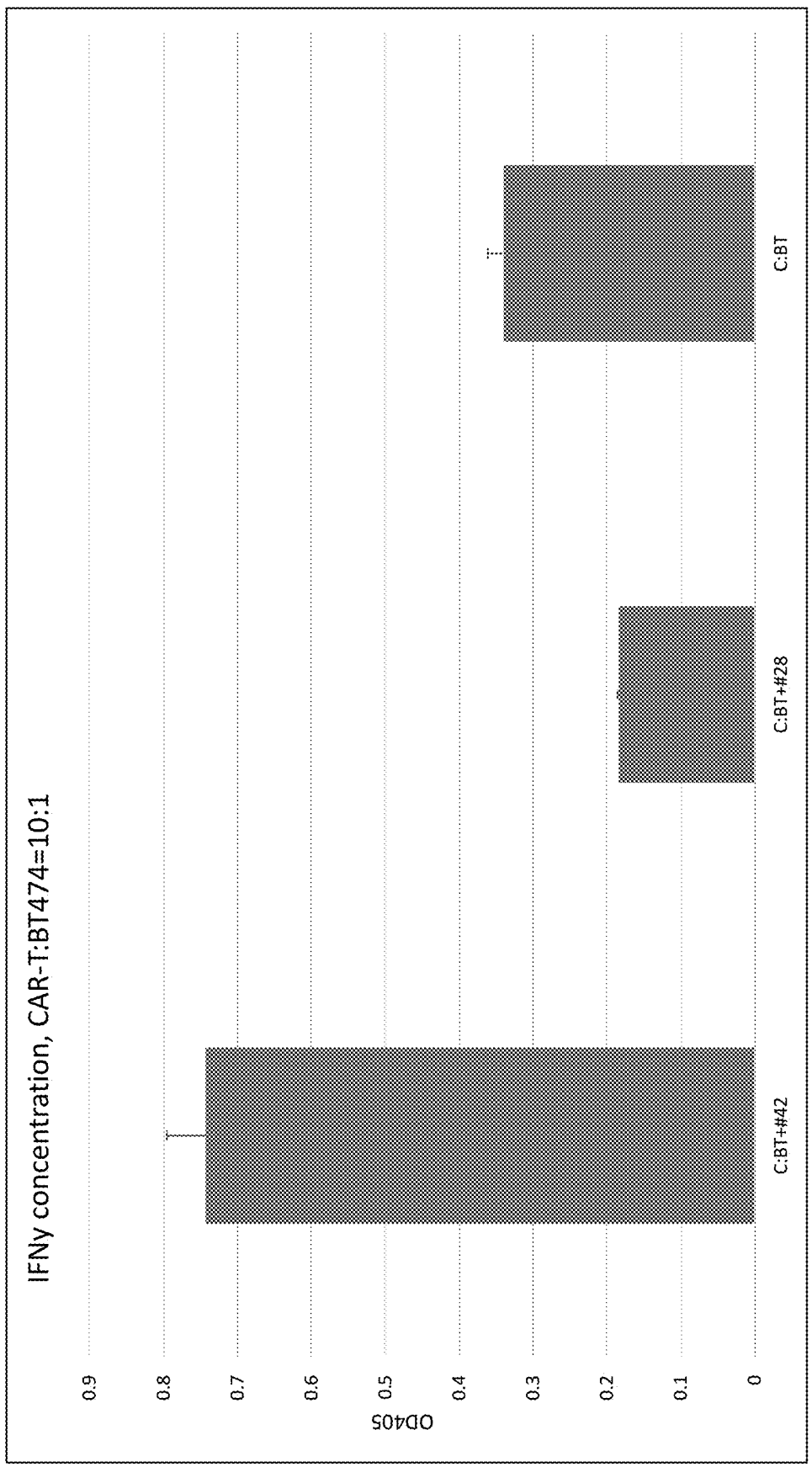
FIG. 47 shows IFNγ ELISA results for BT474 cells coated with indicated peptide and incubated with CD19 specific CAR-T at effector target ratio of 10:1.
Figure 48:
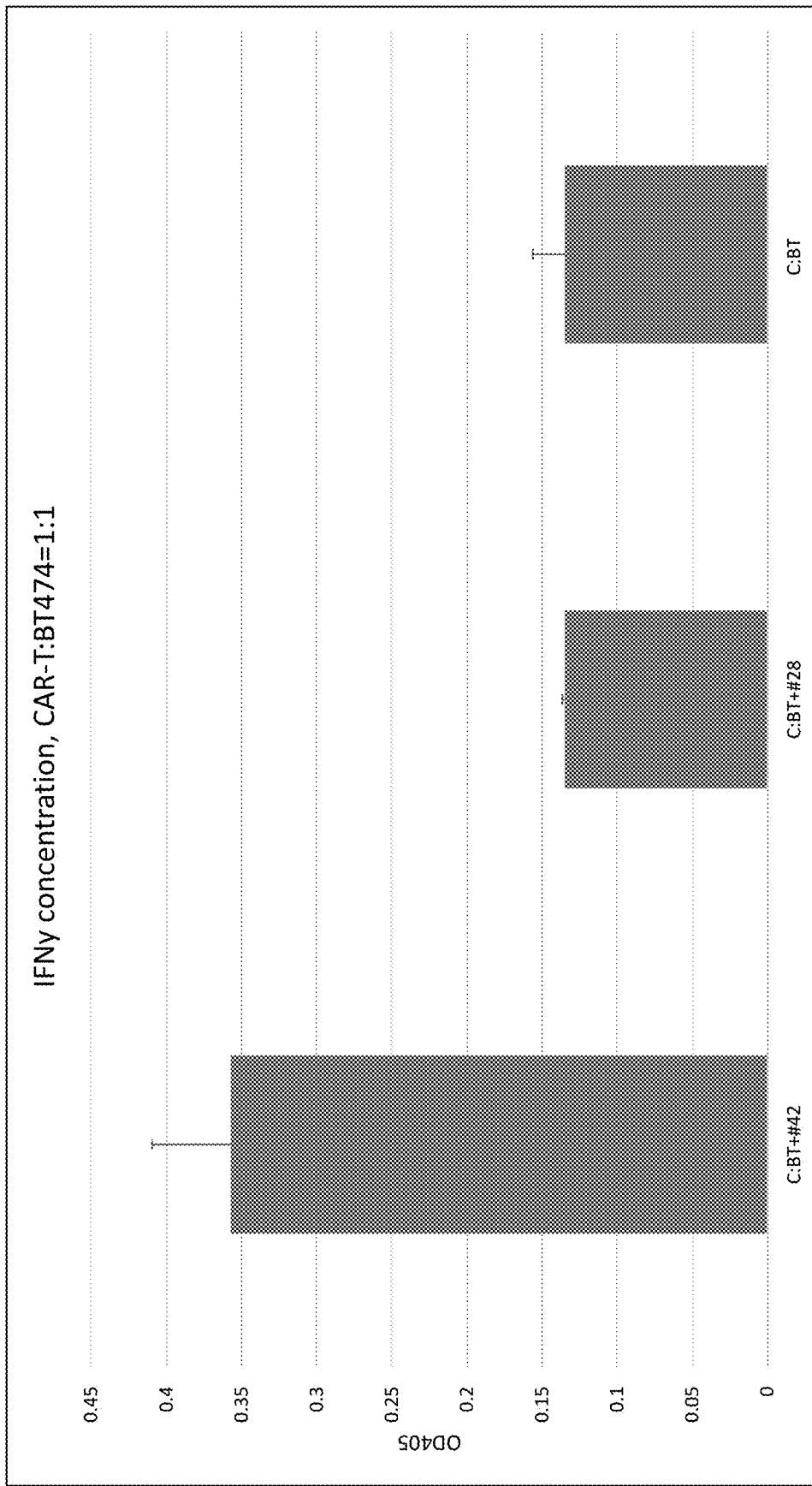
FIG. 48 shows IFNγ ELISA results for BT474 cells coated with indicated peptide and incubated with CD19 specific CAR-T at effector target ratio of 1:1.
Figure 70:
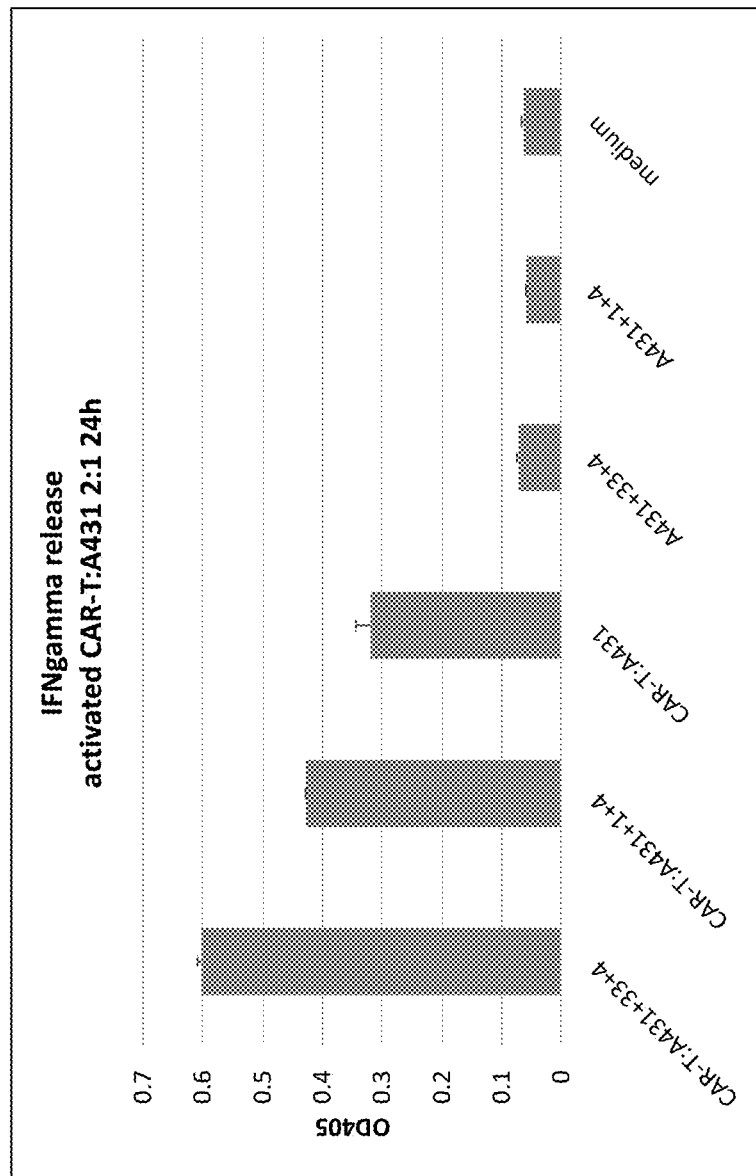
FIG. 70 show results of IFNγ ELISA for fusion protein derived from the cotransfection of construct #33+construct #4 at 24 hrs, 2:1 effector:target ratio.

Summary results of the IFNγ ELISA at 24 hours for construct #42 fusion protein are shown in FIG. 47 (10:1 effector:target ratio) and FIG. 48 (1:1 effector:target ratio). The increase in IFNγ concentration in both cases was >2-fold over background. Summary results of the IFNγ ELISA at 24 hours for construct #83 are shown in FIG. 69A (10:1 effector:target ratio) and FIG. 69B (2:1 effector:target ratio). Summary results of the IFNγ ELISA at 48 hours for construct #83 fusion protein are shown in FIG. 69C (10:1 effector:target ratio) and FIG. 69D (2:1 effector:target ratio). Summary results of the IFNγ ELISA at 24 hours for construct #33-4 are shown in FIG. 70 (2:1 effector:target ratio)

Figure 49:
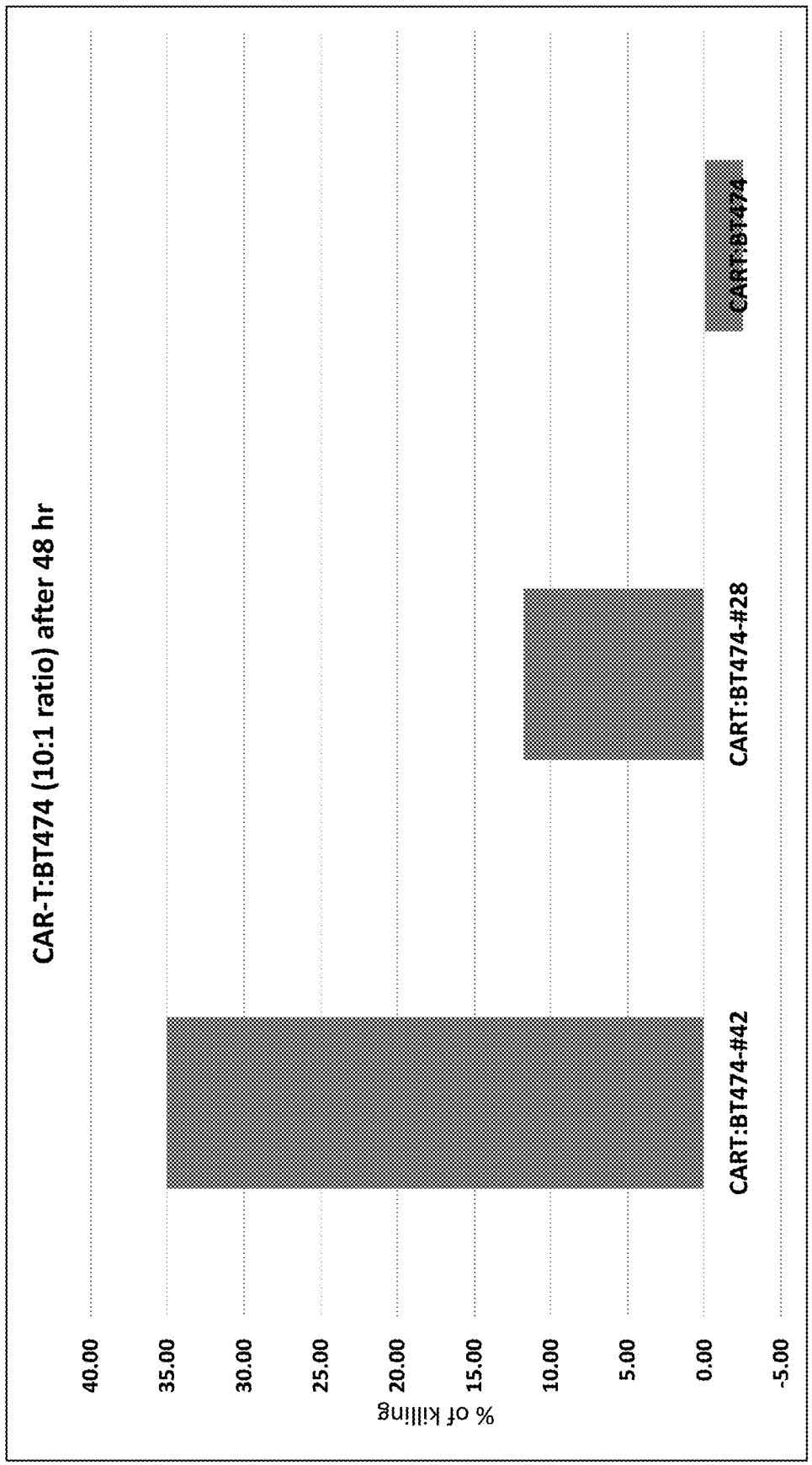
FIG. 49 shows summary XTT-cytotoxicity results for BT474 cells coated with indicated peptide and incubated with CD19 specific CAR-T at effector target ratio of 10:1.
Figure 50:
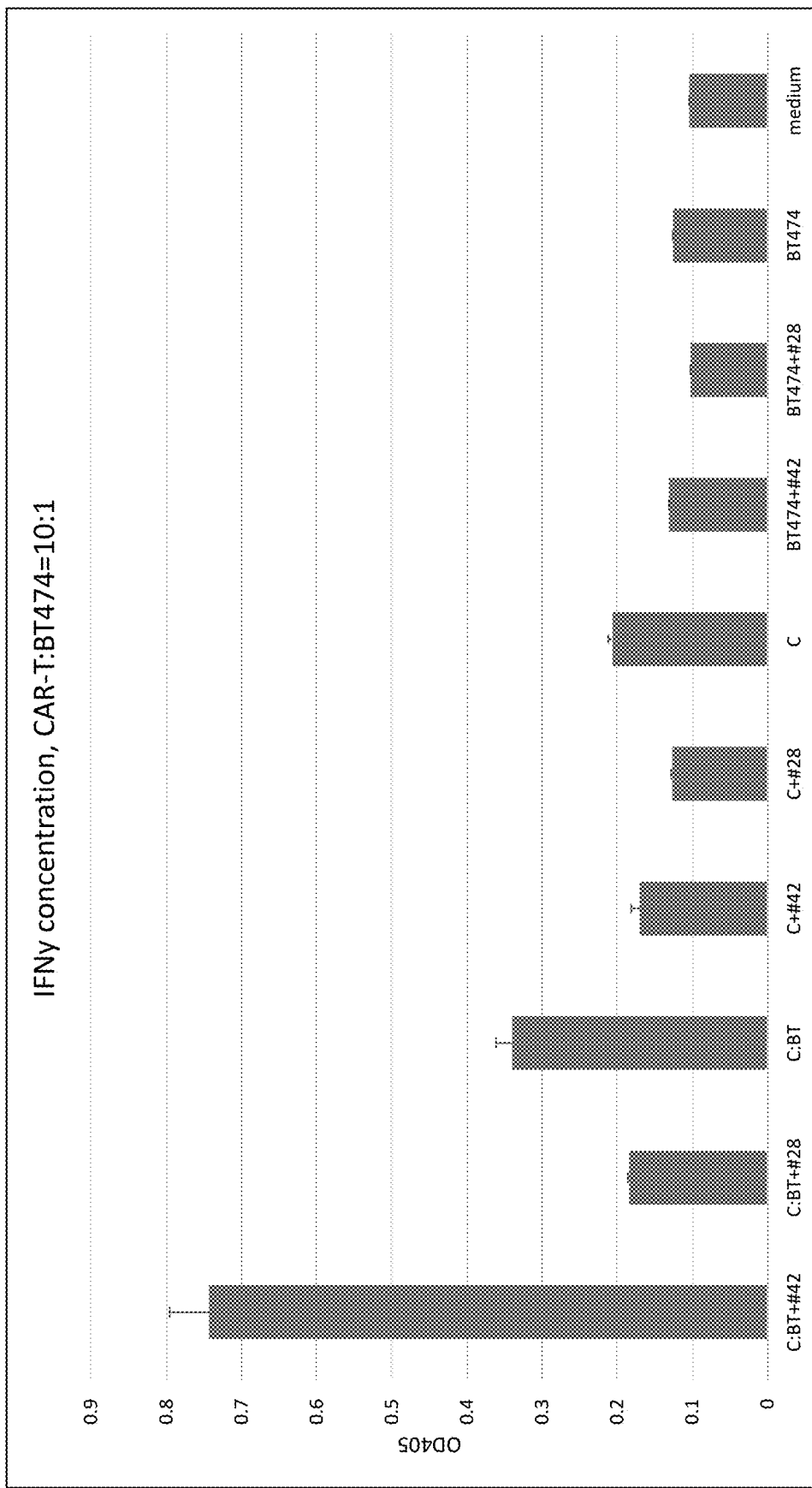
FIG. 50 shows IFNγ ELISA results for BT474 cells coated with indicated peptide and incubated with CD19 specific CAR-T at effector target ratio of 10:1.
Figure 51:
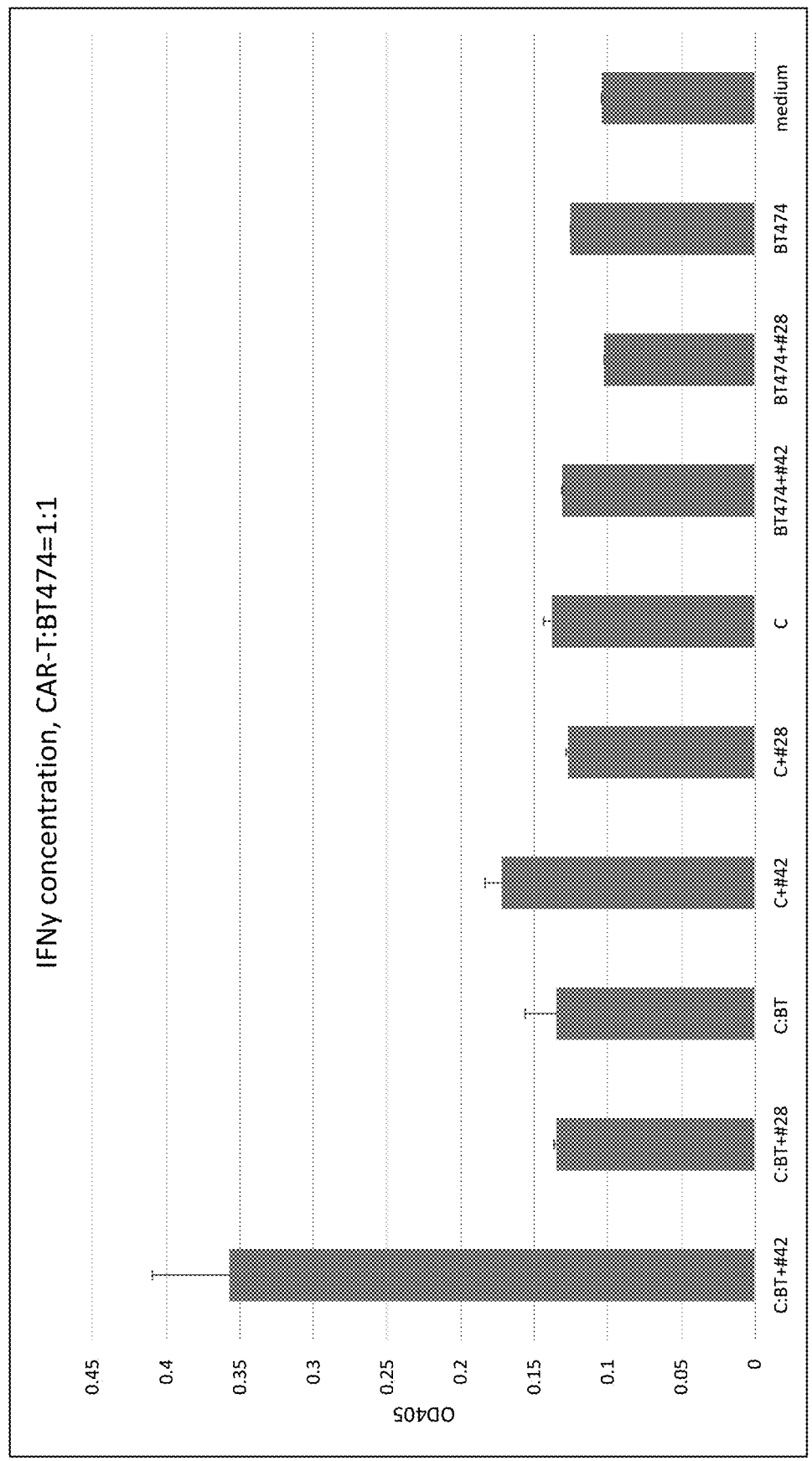
FIG. 51 shows IFNγ ELISA results for BT474 cells coated with indicated peptide and incubated with CD19 specific CAR-T at effector target ratio of 1:1.

FIG. 49 shows summary XTT-cytotoxicity results for the 10:1 effector:target ratio after 48 hours with construct #42 fusion protein and BT474 cells, showing an increase in cytotoxicity>3-fold over background. These results demonstrate that the addition of the fusion protein of construct #42 successfully redirected the targeting activity of the CAR19 T cell to kill a Her2-positive (and CD19-negative) cell. Additional IFNγ concentration controls are provided in FIGS. 50 and 51.

Figure 71A:
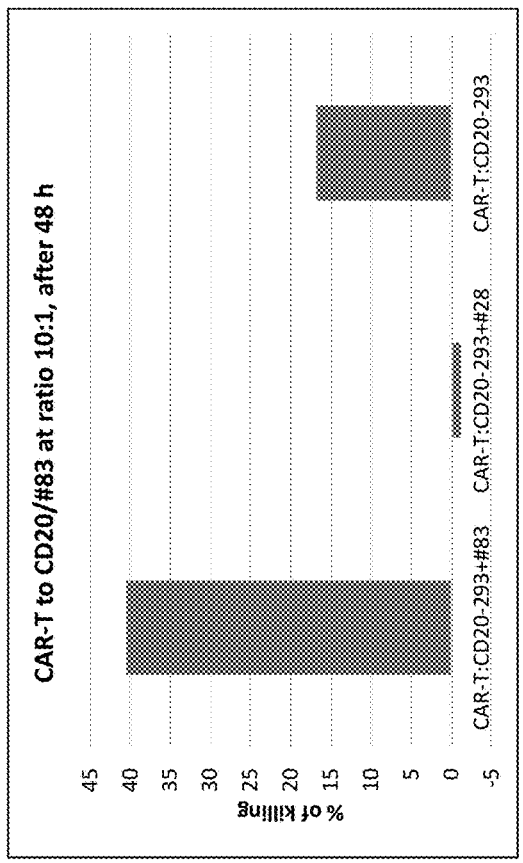
FIGS. 71A and 71B show summary XTT-cytotoxicity results for fusion protein #83 and 293-CD20 cells.
Figure 71B:
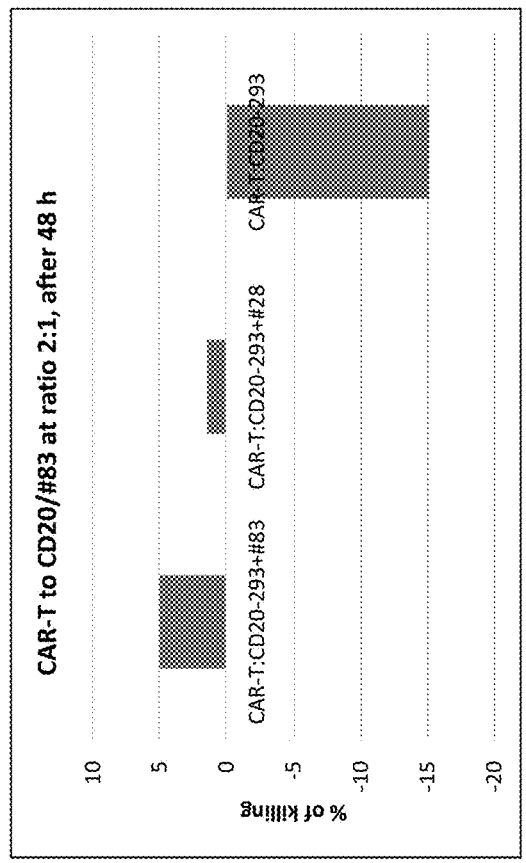

FIG. 71A shows summary XTT-cytotoxicity results for the 10:1 effector:target ratio after 48 hours with construct #83 fusion protein and 293-CD20 cells. FIG. 71B shows summary XTT-cytotoxicity results for the 2:1 effector:target ratio after 48 hours with construct #83 fusion protein and 293-CD20 cells. A negative value indicates active cell growth over the course of the assay. These results demonstrate that the addition of the fusion protein (#83) successfully redirected the targeting activity of the CAR19 T cell to kill a CD20-positive (and CD19-negative) cell via the anti-CD20 scFv-CD19 protein fusion.

Figure 72B:
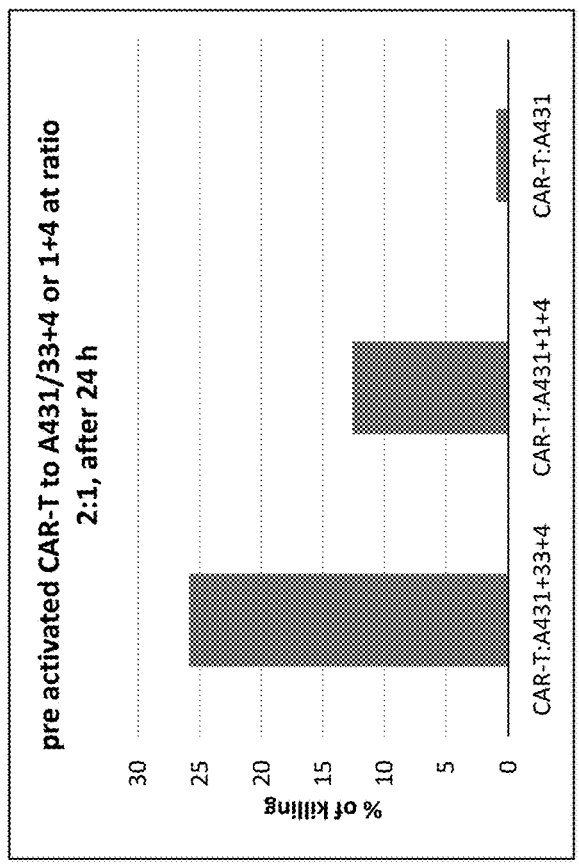
FIGS. 72A and 72B show summary XTT-cytotoxicity results for fusion protein derived from the cotransfection of construct #33+construct #4 and A4321 cells.
Figure 72A:
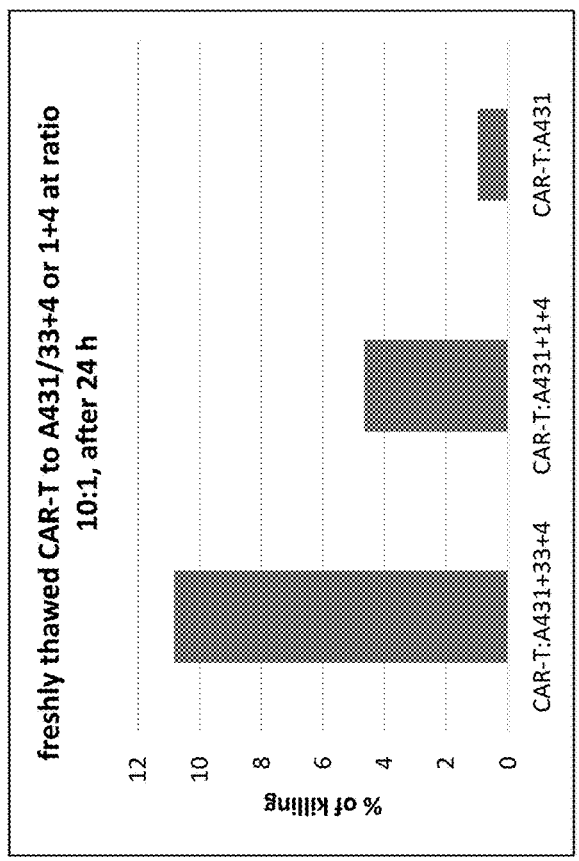
Figures 77A, 77B:
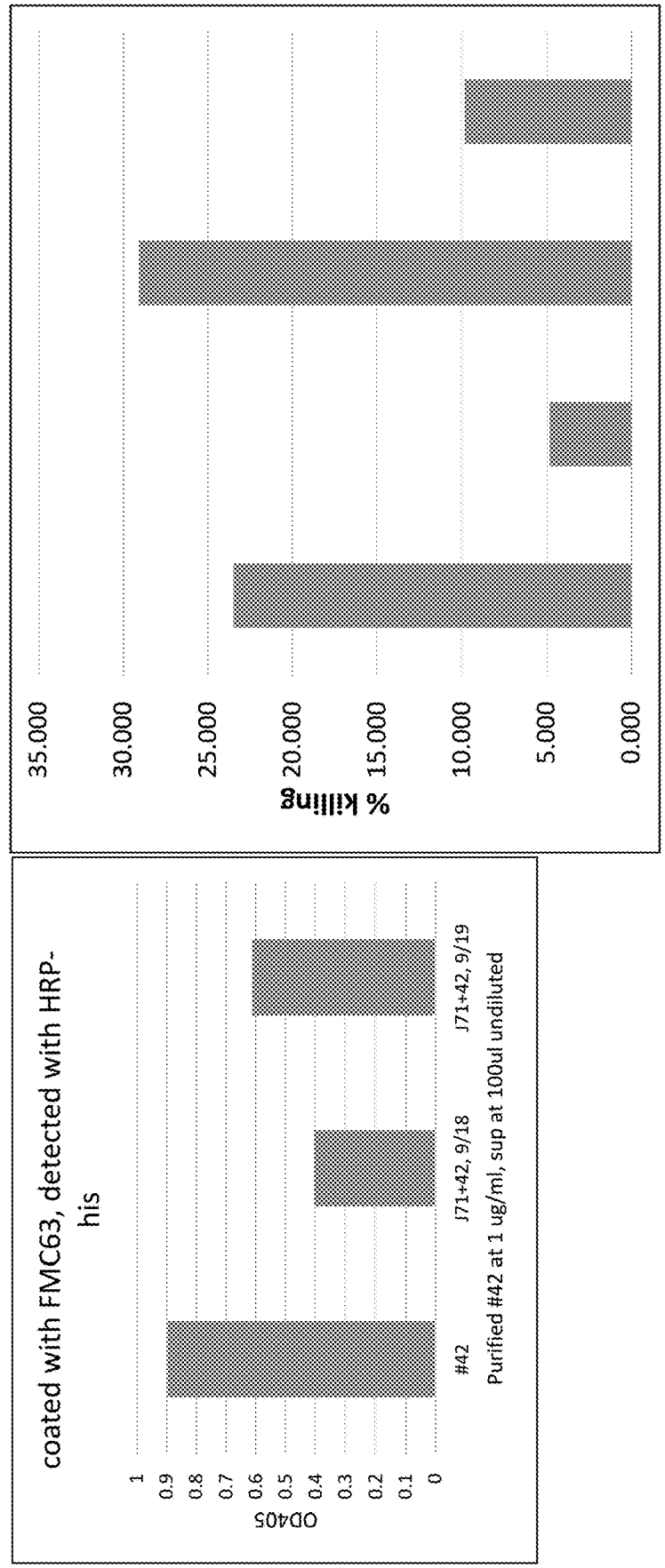
FIGS. 77A and 77B show CAR19-mediated cytotoxicity redirected to HER2+cells by CAR19 T cell secretion of fusion protein encoded by construct #42.

FIG. 72A shows summary XTT-cytotoxicity results for the 10:1 effector:target ratio after 24 hours with fusion protein from constructs #33+#4 and A4321 cells. FIG. 72B shows summary XTT-cytotoxicity results for the 2:1 effector:target ratio after 24 hours with fusion protein from constructs #33+#4 and A4321 cells. These results demonstrate that the addition of the fusion protein (from construct #33+#4, coexpressed) successfully redirected the targeting activity of the CAR19 T cell to kill a EGFR-positive (and CD19-negative) cell via the anti-EGFR-CD19 protein fusion. FIG. 77A shows expression and secretion of construct #42 fusion protein secreted from transfected Jurkat cells stably expressing a CD19 CAR construct (SEQ ID NO. 71: FMC63 CAR-19 construct Flag-tagged-1). Detection of secretion of the fusion protein was performed by ELISA procedures described herein using antibody FMC63 to capture and HRP-confugated anti-HIS antibody to detect. FIG. 77B shows CAR19-mediated cytotoxicity redirected to HER2+cells by CAR19 T cell secretion of fusion protein encoded by construct #42. $1 \times 10^4$ HER2+BT474 cells were plated in each well of a 12 well cell culture plate. The Jurkat-#71 stable line with or without #42 inserted was added to the wells containing BT474 cells at a ratio of 2:1 for cytotoxicity analysis using the XTT assay. The assay was performed after 24 hours of coculture of the T cells with the BT474 cells. Positive controls for the assay were the use of purified fusion protein from construct #42 fusion protein bridging with Jurkat-71, and use of purified fusion protein from construct #42 fusion protein bridging with CAR19 T cells (Promab). Jurkat cells stably transfected with the CAR19 construct #71 and then transiently transfected with construct #42 were able to secrete the encoded #42 fusion protein and mediate redirected killing of HER2+BT474 cells.

Example 9. Analysis of Constitutive and Inducible Promoters in Jurkat Cells

Methods

Jurkat cells were grown in RPMI media containing 10% Fetal Bovine Serum (Gibco) and were transfected using the Invitrogen NEON™ electroporation system as follows. All steps were done at room temperature. Approximately $1.4 \times 10^7$ cells were centrifuged at 1000 rpm for 3 minutes. The supernatant was removed and the cells washed two times with PBS without calcium or magnesium (Gibco) then centrifuged as above. The cells were resuspended in 1.3 ml of the R Resuspension buffer, provided in the NEON™ transfection system 100 µl kit (cat. #MPK10096). 100 µl of the cell suspension containing approximately $10^6$ Jurkat cells was used for each electroporation. A maximum volume of 10 µl for each DNA construct (minimum DNA concentration 0.73 µg/µl; maximum DNA concentration 1.48 µg/µl) was added to a 1.5 ml tube prior to distribution of the cells. The mixture was mixed gently and pulled up into a NEON™ tip. The cells plus DNA mixture were electroporated on the setting 1600 volts, 10 ms and 3 pulses in the NEON™ electroporation tubes filled with 3 ml of Electrolytic Buffer E2, provided in the NEON™ transfection system kit. The cells were then put into 2 ml RPMI/10% FBS in a 6 well dish and incubated overnight at 37° C. and 5% $CO_2$. On day 2, the cells from each well were pipetted up and down and transferred into 2 wells of a 12 well dish (1 ml each). One well remained unstimulated and the other well was stimulated with PMA (50 ng/ml) and Ionomycin (1 µg/ml) for various lengths of time. Expression of the GFP reporter was read in the FL1 channel by a Flow Cytometer (ACCURI™, BD Biosystems) at 6 hrs, 18 hrs or 48 hrs. The activation state of the cells was determined using anti-human CD69 staining (Browning, J. L et al. 1997. J. Immunol. 159:3288-3298).

The following constructs were evaluated: CMV promoter-tGFP (SEQ ID NO:266); human CD69 promoter-tGFP (SEQ ID NO:246); human TNFalpha promoter-tGFP (SEQ ID NO:247); and NFAT element×6 promoter-tGFP (SEQ ID NO:249). Electroporation without DNA was used as a control.

Flow cytometry was performed using $5 \times 10^5$ cells/test, gated on FL1 to detect tGFP. The anti-CD69-PE conjugated antibody was used at 10 µl/test in 100 µl (BD Biosystems). The PE (phycoerythrin) fluorescent dye-conjugated antibody to CD69 was read in the FL2 channel. The FACS buffer was PBS containing 1% BSA and 0.1% Sodium Azide. After a final wash the cells were fixed in 2% paraformaldehyde.

Results

Figure 61C:
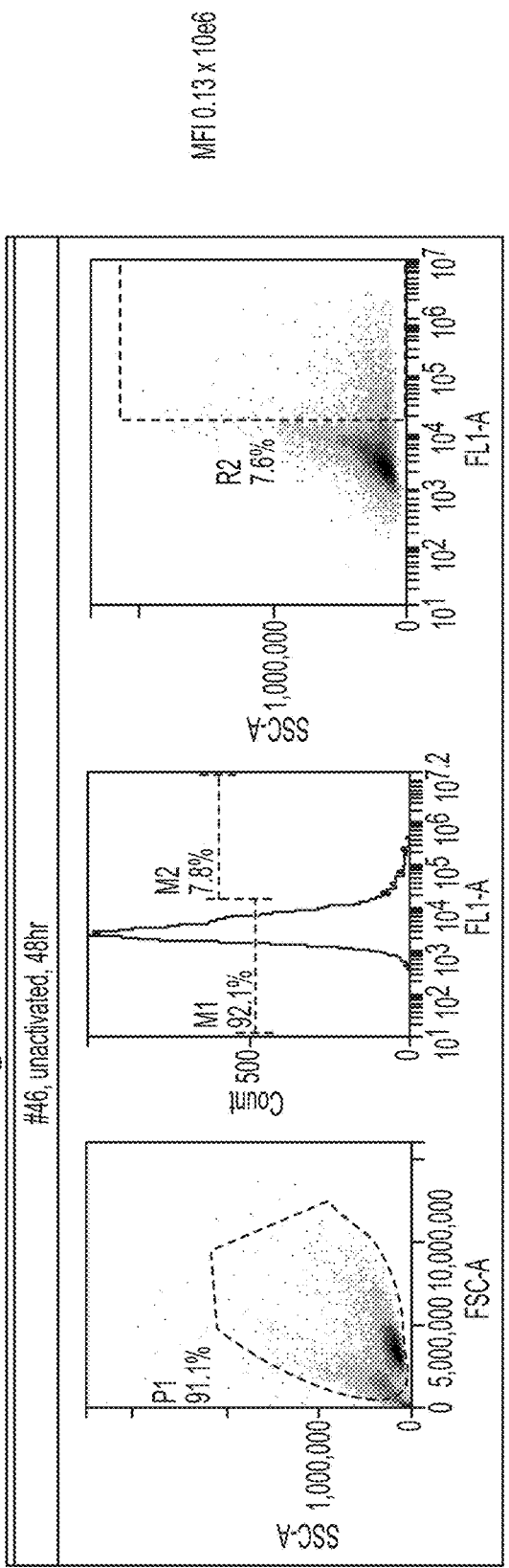
Figure 61D:
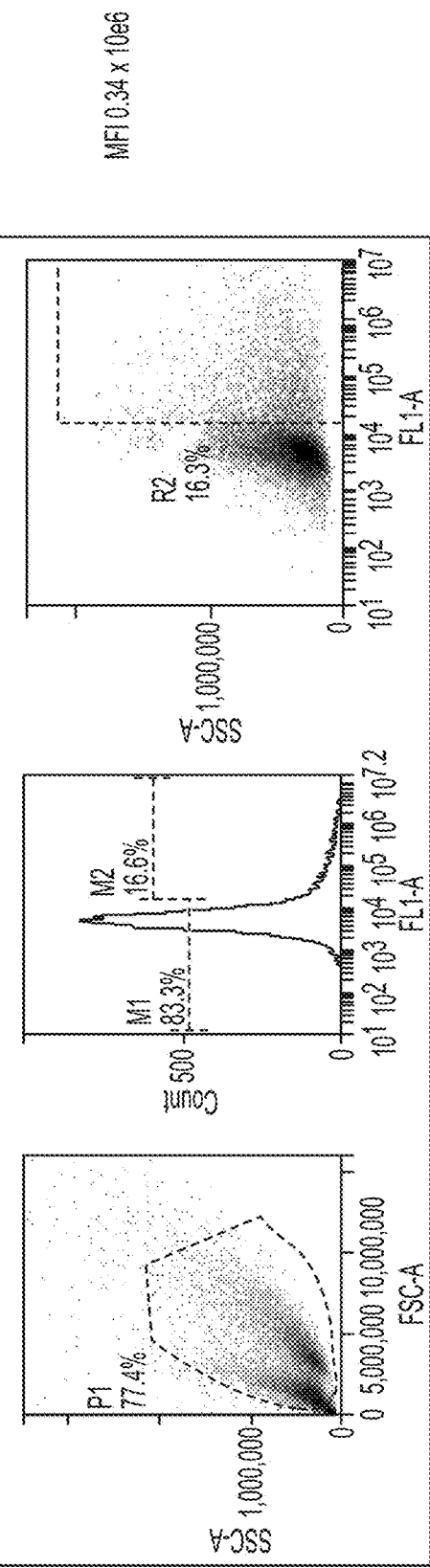
Figure 64A:
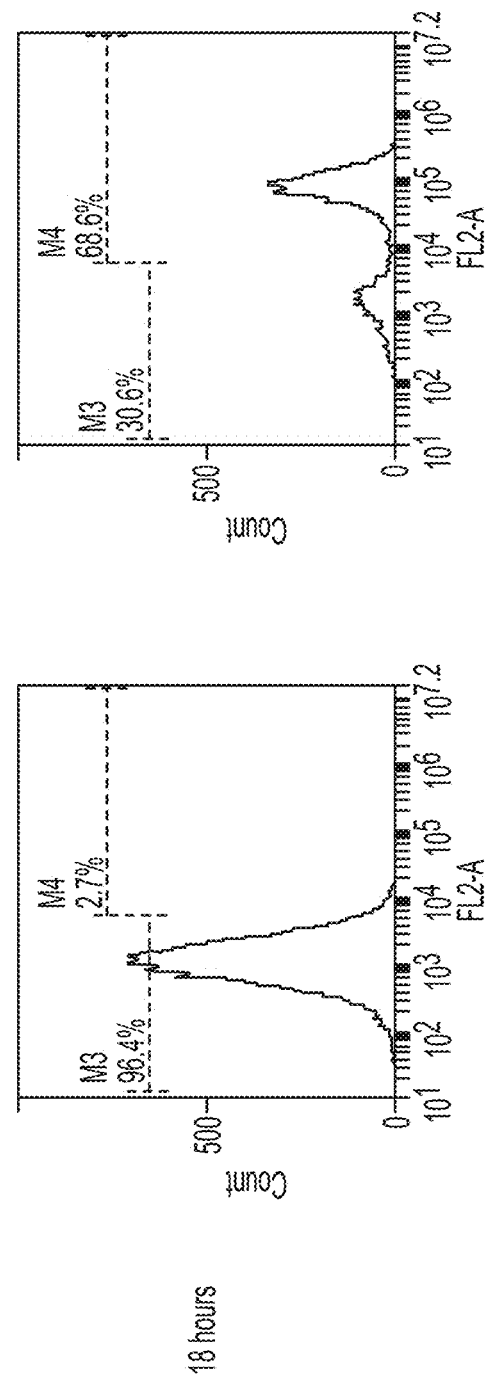
FIGS. 64A-64B show analysis of expression of CD69 on the surface of cells under resting or activated conditions.
Figure 64B:
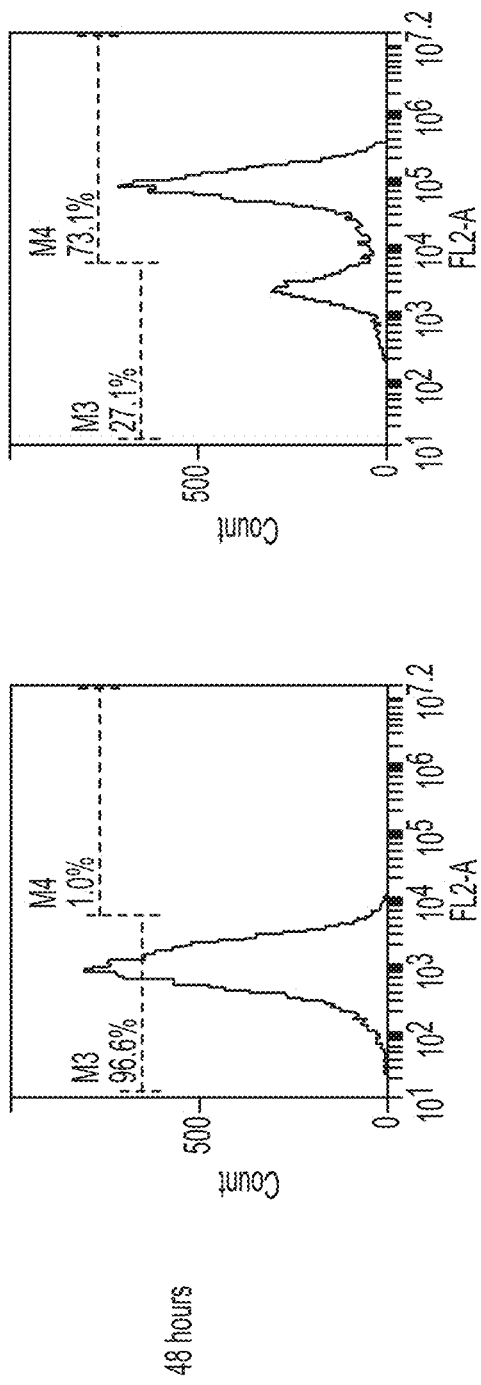

As shown in FIGS. 61B and 61D, the constitutive CMV promoter was modestly impacted by Jurkat cell activation, with approximately 4% more cells present in the tGFP gate at increased MFI. The constitutive activation was sufficient however, as shown in the unactivated samples having 14.7-17.9% cells in the positive gate (see FIGS. 60A and 60C).

For the inducible promoters, cells were activated using PMA and Ionomycin to mimic canonical T cell activation. Under these activation conditions ("P+I") the TNF promoter had a marked impact on MFI at 6 hours (see FIGS. 62A-D), and the CD69 promoter has a dramatic impact on both % positive cells and MFI at 48 hours (see FIGS. 61A-61D). These findings were consistent with the known kinetics of TNF and CD69 upregulation following T cell activation, where TNF has rapid but short-lived activation, while CD69 comes up gradually and then remains elevated (Sareneva, T. et al. 1998. Immunology 93: 350-357; Browning, J. L et al. 1997. J. Immunol. 159:3288-3298). Expression of CD69 on the cell surface shows upregulation at 18 hours continuing to 48 hours (see FIGS. 64A-64D), in support of the CD69-tGFP promoter data. NFATx6 had a modest impact at 6 hours only and appeared to be the weakest promoter of those shown here (see FIGS. 63A-D). The results are summarized in the following Table:

| Promoter | activation | 6 hr % pos | 6 hr MFI | 18 hr % pos | 18 hr MFI | 48 hr % pos | 48 hr MFI |
|---|---|---|---|---|---|---|---|
| constitutive | | | | | | | |
| CMV | − | 14.7 | 1.3 | | | 17.9 | 0.5 |
| CMV | + | 19 | 1.6 | | | 22 | 1.1 |
| inducible | | | | | | | |
| TNF | − | 33.8 | 1.5 | 0.1 | 0.02 | | |
| TNF | + | 39.3 | 2.2 | 0.1 | 0.03 | | |
| NFATx6 | − | 4 | 0.2 | 0 | 0.02 | | |
| NFATx6 | + | 5.6 | 0.7 | 0.1 | 0.025 | | |
| CD69 | − | | | 20.5 | 0.6 | 7.6 | 1.3 |
| CD69 | + | | | 24 | 1 | 16.3 | 3.4 |

% Pos refers to the percentage of cells in the R2 (tGFP-positive) gate in the FACS plots; MFI is the mean fluorescence of the cells within the R2 gate (cell number x $10^6$). The no-DNA negative control cell cultures had on average a "% Pos" value of less than 0.5 and an "MFI" of less than 0.03.

Example 10. Analysis of Heteromeric Fusion Proteins

Methods

Co-expression of CD19-D1+D2-huIgGFc (construct #29 described in Example 5) and Trastuzumab scFv (VH/VL)-huIgGFc (amino acid SEQ ID NO:103; nucleotide SEQ ID NO:303; construct #103) were analyzed in 293T cells. 293T cells were transfected using Lipofectamine™ 2000 with nucleotide sequences encoding construct #29 only or #29 plus #103; supernatants were harvested after 3 days. An ELISA plate was coated with mAb FMC63 for detection of construct #29 homodimers and with HER2-huIgGFc for detection of construct #29+#103 heterodimers. The supernatants were added to the coated plate and allowed to incubate for 1 hour. After washing, bound protein was detected using an HRP-conjugated anti-huIgG antibody for homodimer of #29. The heterodimer of #29+#103 was detected via the binding of mAb FMC63 followed by HRP-conjugated mouseIgG antibody.

Figure 78:
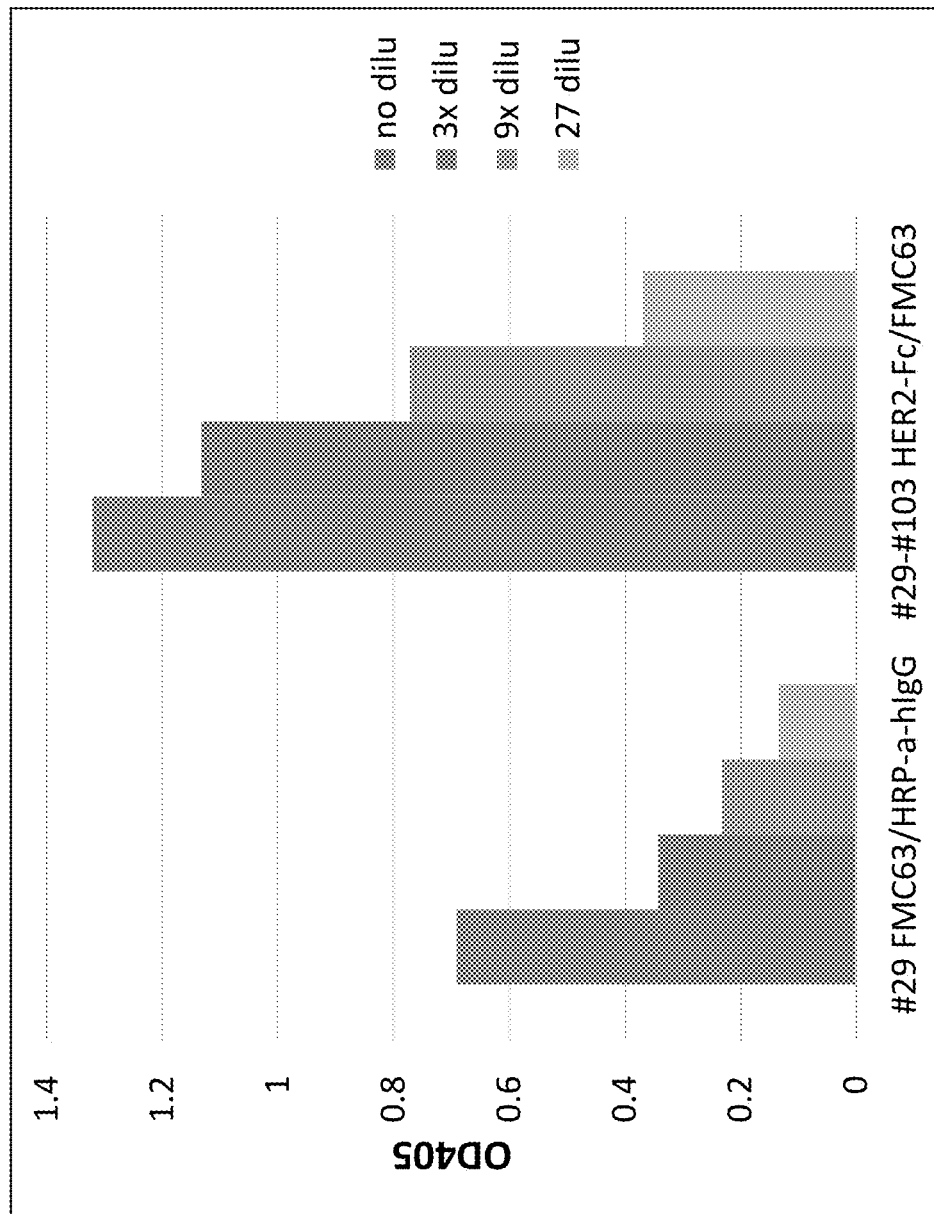
FIG. 78 shows binding of a heteromeric fusion protein comprised of fusion proteins #29 and #103 to anti-CD19 antibody FMC63 detected by HRP-conjugated mouse IgG antibody.

FIG. 78 shows co-transfecting construct #29 (expressing CD19-D1+D2-huIgGFc) together with construct #103 (expressing Trastuzumab scFv (VH/VL)-huIgGFc) results in the formation of homodimers and a heterodimer, where one arm is CD19-D1+D2-huIgGFc and the other arm is Trastuzumab scFv (VH/VL)-huIgGFc. Formation of the heterodimer was detected by capturing the complex using the ligand for Trastuzumab (Her2-Fc) and detecting using the anti-CD19 mAb, FMC63.

Example 11—Yeast Display of CD19 and Variants

As discussed in the disclosure, in some embodiments, CD19 can be used as a scaffold to produce CD19 variants that can bind to targets of interest. This Example demonstrates the production of yeast display libraries to screen for such CD19 variants.

Yeast Display of Wild-Type CD19 Extracellular Domain

Figure 79B:
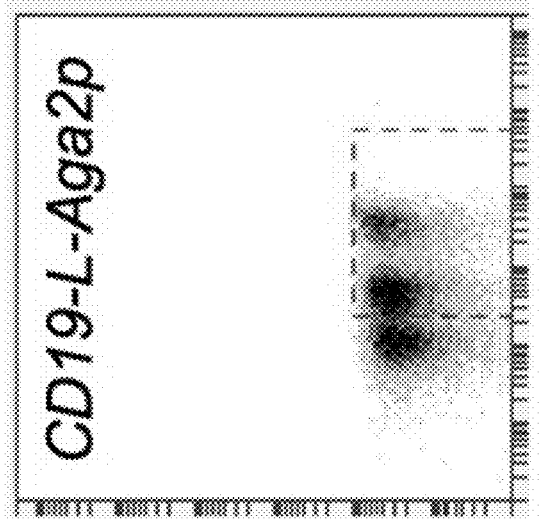
FIGS. 79A and 79B shows yeast surface display of wild-type CD19 extracellular domain.
Figure 79A:
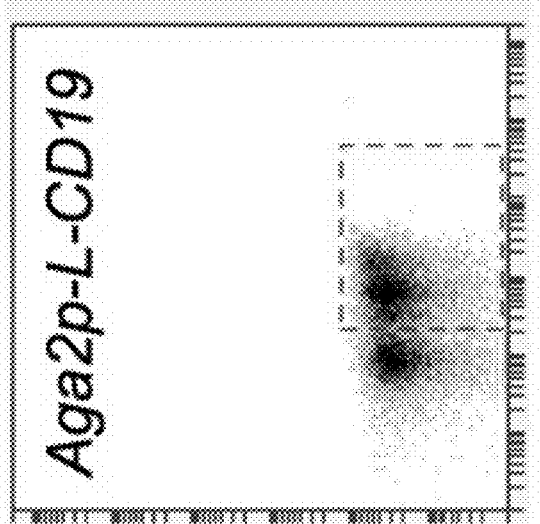

The extracellular domain of human wild-type CD19 (amino acids 1-272) was genetically fused either C-terminal or N-terminal to Aga2p, via a polypeptide linker. The fusion constructs, with C-terminal c-myc epitope tags, were expressed within EBY100 Saccharomyces cerevisiae yeast. CD19 expression per yeast was evaluated by flow cytometry following labeling with fluorescein-conjugated mouse-anti-c-myc epitope antibody (Bethyl). Experiments were performed as described in Chao et al., Isolating and engineering human antibodies using yeast surface display. Nat. Protoc. 1, 755-768 (2006). As shown in FIG. 79, wild-type CD19 extracellular domain was effectively displayed on the yeast surface as a fusion to Aga2p in either Aga2p-linker-CD19 (FIG. 79A) or CD19-linker-Aga2p (FIG. 79B) format.

The Yeast-Displayed CD19 ECD Effectively Binds to Anti-CD19 Monoclonal Antibodies (mAbs)

Figure 80:
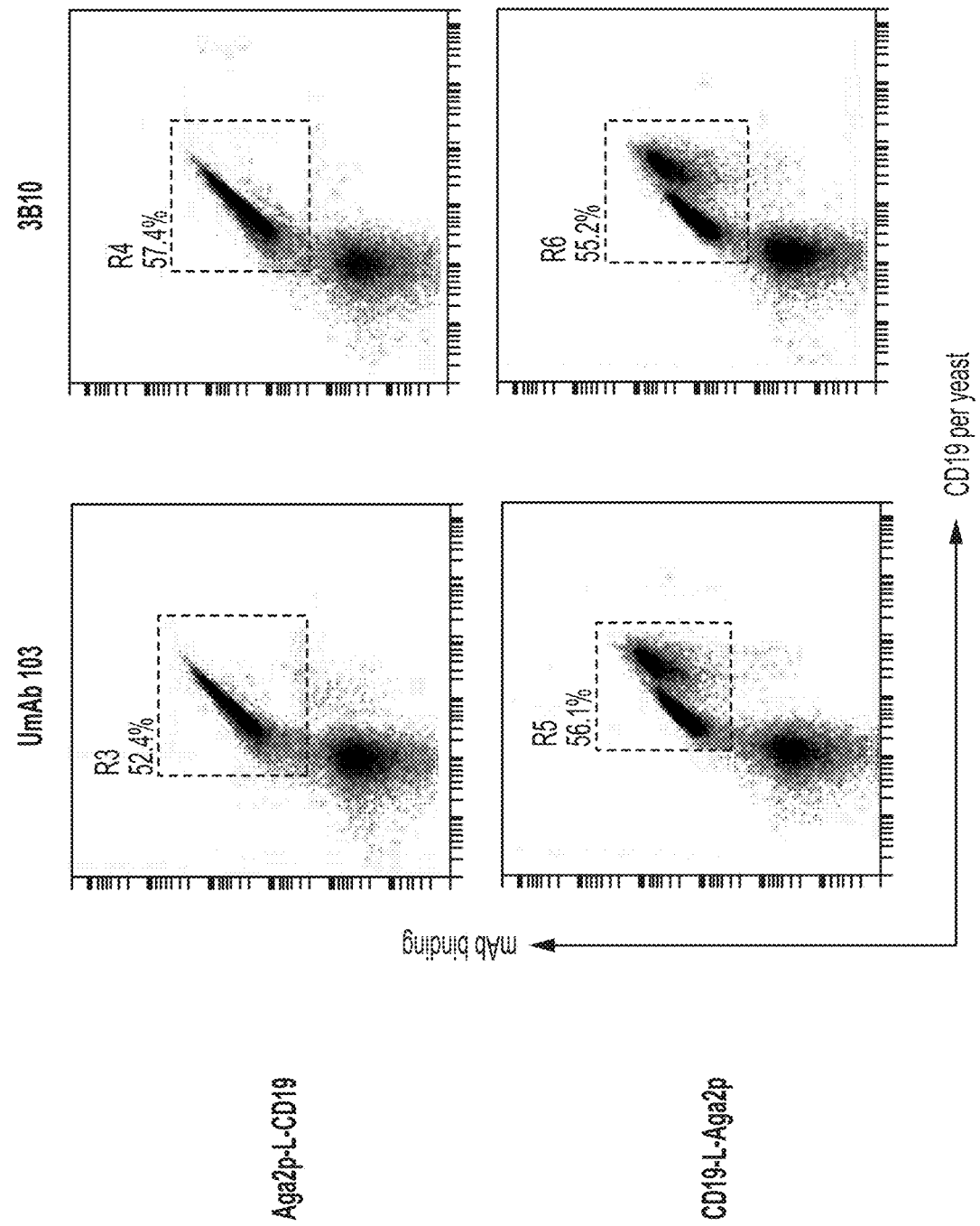
FIG. 80 shows antibody binding to yeast-displayed CD19 extracellular domain.

The fusion constructs, with C-terminal c-myc epitope tags, were expressed within EBY100 Saccharomyces cerevisiae yeast. CD19 expression per yeast and antibody binding were evaluated by flow cytometry following labeling with fluorescein-conjugated goat-anti-c-myc epitope antibody as well as the indicated mouse monoclonal antibody followed by AlexaFluor647-conjugated anti-mouse antibody. Experiments performed as in Chao et al., Isolating and engineering human antibodies using yeast surface display. Nat. Protoc. 1, 755-768 (2006). As shown in FIG. 80, yeast-displayed CD19 extracellular domain effectively bound to commercially available anti-CD19 mAbs UltramAb103 (Origene) and 3B10 (Novus).

Generation and Initial Analysis of Combinatorial Ligand Libraries

Figure 81:
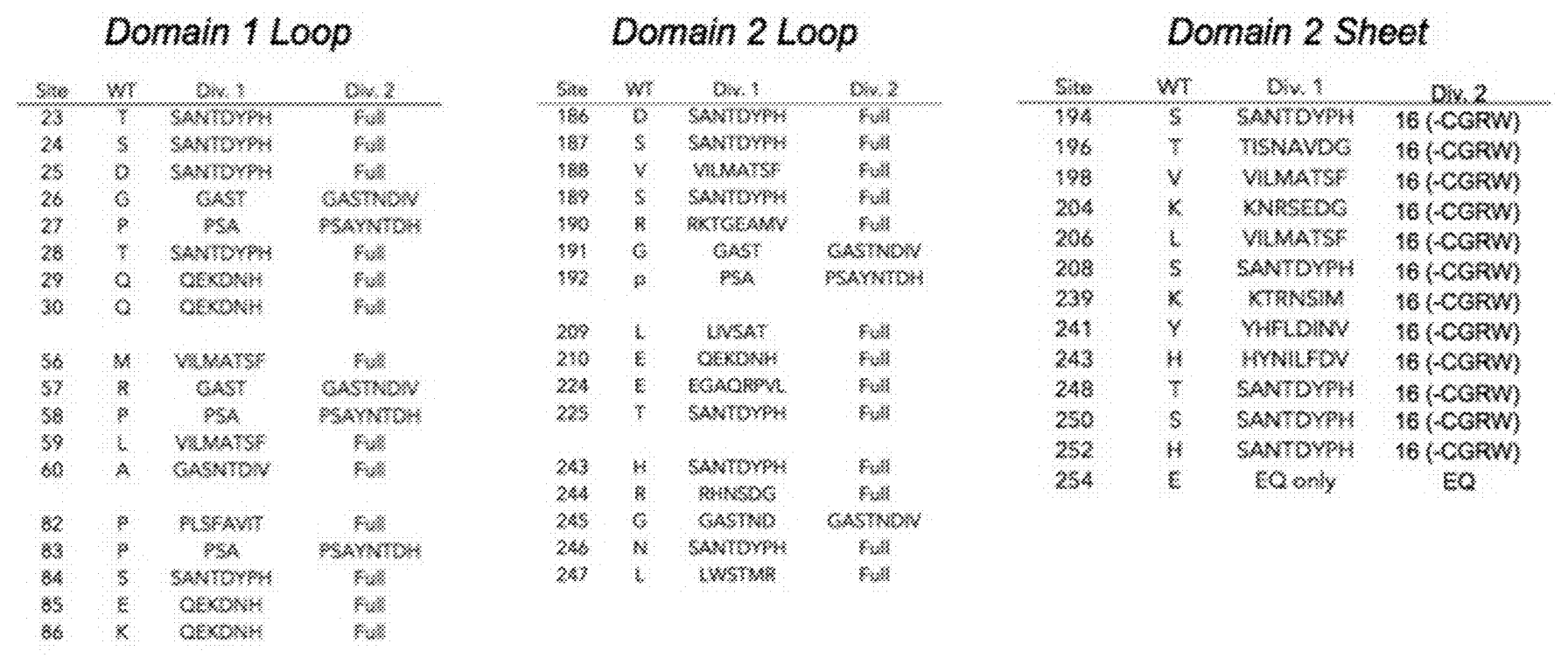

The CD19 ECD can be diversified to generate new binding functionality to a variety of molecular targets (see Woldring et al., High-Throughput Ligand Discovery Reveals a Sitewise Gradient of Diversity in Broadly Evolved Hydrophilic Fibronectin Domains. PLoS One 10, e0138956 (2015)). To exemplify this, the solvent-exposed loops in Ig domain 1, or Ig domain 2, or the beta sheet surface in Ig domain 2, were varied. Example diversity designs are indicated in FIG. 81. The homology model was determined as follows. The 258 residue amino acid sequence of CD19 comprised of the N-terminal domain, domain linker, and C-terminal domain was submitted to HHPred3 using the default parameters. HHPred makemodel was then used to make a model for MODELLER4 using the automatically pick best template option. The optimal single template (1qz1) was selected for MODELLER (Note: the option for selecting the multiple optimal templates also output a structure similar to 1qz1). The output structure was then refined in Foldit5 standalone by side-chain repacking, and full-structure minimization.

Figure 82:
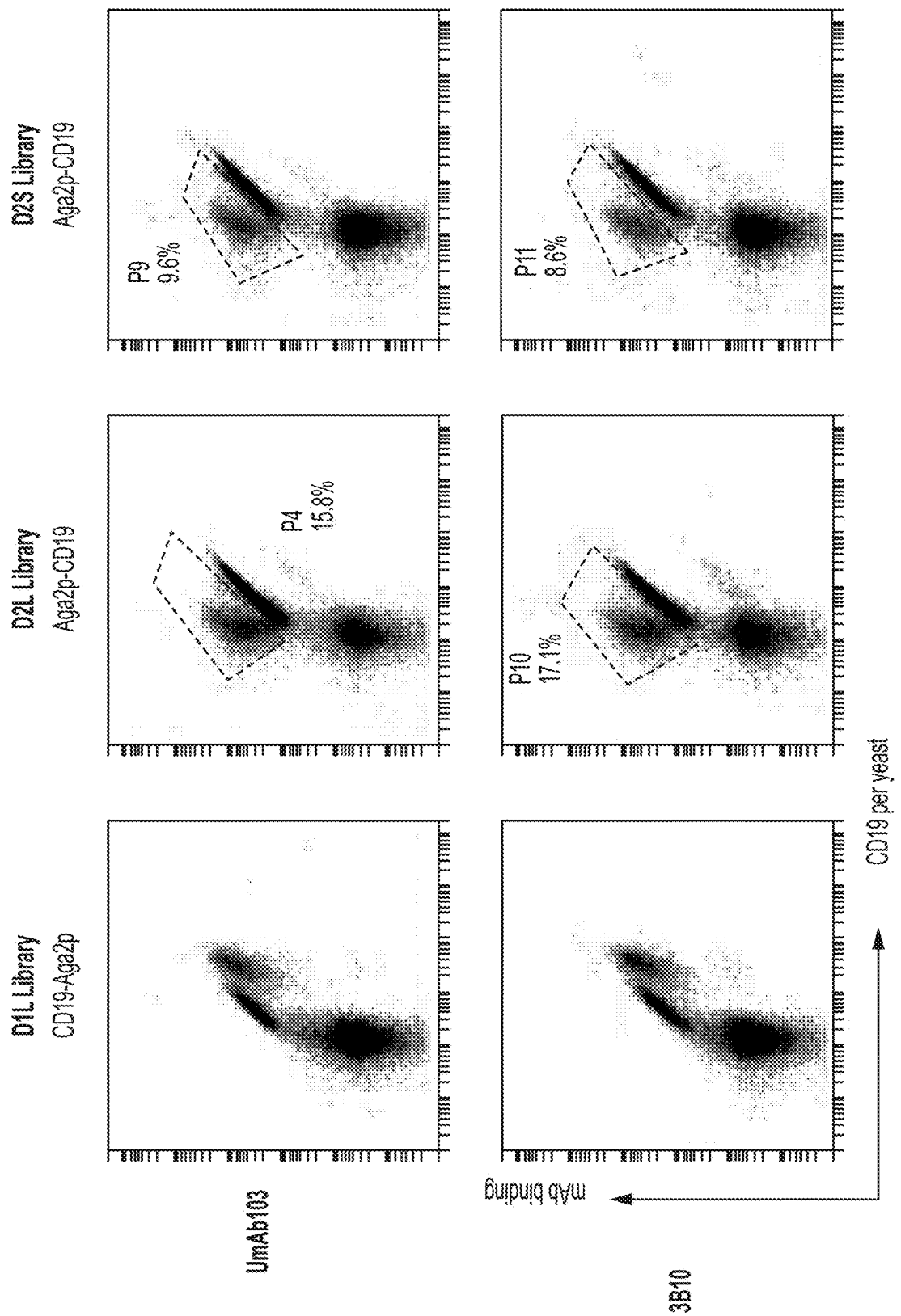
FIG. 82 demonstrates combinatorial CD19 libraries are effectively displayed on yeast surface and maintain antibody binding.

These example libraries were constructed at the genetic level ($>1\times10^8$ yeast transformants) as described in Woldring et al., High-Throughput Ligand Discovery Reveals a Sitewise Gradient of Diversity in Broadly Evolved Hydrophilic Fibronectin Domains. PLoS One 10, e0138956 (2015). CD19 expression per yeast and antibody binding were evaluated by flow cytometry following labeling with fluorescein-conjugated goat-anti-c-myc epitope antibody as well as the indicated mouse monoclonal antibody followed by AlexaFluor647-conjugated anti-mouse antibody as described in Chao et al., Isolating and engineering human antibodies using yeast surface display. Nat. Protoc. 1, 755-768 (2006). Variants were effectively displayed on the yeast cell surface and maintained binding to mAbs UltramAb103 and 3B10 (FIG. 82), suggesting that the mutated CD19 ECD retained its overall structure.

Ligand Discovery from Combinatorial Libraries can Effectively Yield Novel Binding Molecules.

The example libraries were sorted for binders to biotinylated epidermal growth factor receptor (EGFR) and biotinylated human epidermal growth factor receptor 2 (HER2) using magnetic bead selections (as described in Woldring et al., High-Throughput Ligand Discovery Reveals a Sitewise Gradient of Diversity in Broadly Evolved Hydrophilic Fibronectin Domains. PLoS One 10, e0138956 (2015); Ackerman et al., Highly avid magnetic bead capture: an efficient selection method for de novo protein engineering utilizing yeast surface display. Biotechnol. Prog. 25, 774-783 (2009); Hackel et al., Stability and CDR Composition Biases Enrich Binder Functionality Landscapes. J. Mol. Biol. 401, 84-96 (2010)). Selective enrichment of binders to EGFR and HER2 were revealed from all three libraries (FIG. 83). FIG. 83A depicts results of resultant ligand populations evaluated for binding to avidin (Ctl A and CtlB) or the desired target (EGFR or HER2). Substantial preference for the desired target was observed. FIG. 83B depicts results from analysis of domain 2 sheet library, which was sorted twice for binding to HER2, labeled with 50 nM biotinylated IgG (left panel) or biotinylated HER2 (right panel), followed by streptavidin-AlexaFluor647. Yeast were also labeled with mouse anti-c-myc antibody followed by anti-mouse-AlexaFluor488. Select variants exhibit strong HER2-specific binding (right panel, upper right quadrant).

EQUIVALENTS

Those skilled in the art will recognize, or be able to ascertain using no more than routine experimentation, many equivalents to the specific embodiments of the invention described herein. The scope of the present invention is not intended to be limited to the above Description, but rather is as set forth in the following claims:

Listing of Amino Acid Sequences

SEQ ID NO. 1
MEFGLSWVFLVALFRGVQCQVQLQESGPGLVKPSETLSLTCTVSGGSVSSGDYYWTWIRQ

SPGKGLEWIGHIYYSGNTNYNPSLKSRLTISIDTSKTQFSLKLSSVTAADTAIYYCVRDR

VTGAFDIWGQGTMVTVSSASTKGPSVFPLAPCSRSTSESTAALGCLVKDYFPEPVTVSWN

SGALTSGVHTFPAVLQSSGLYSLSSVVTVPSSNFGTQTYTCNVDHKPSNTKVDKTVERKC

```
CVECPPCPAPPVAGPSVFLFPPKPKDTLMISRTPEVTCVVVDVSHEDPEVQFNWYVDGVE
VHNAKTKPREEQFQSTFRVVSVLTVVHQDWLNGKEYKCKVSNKGLPAPIEKTISKTKGQP
REPQVYTLPPSREEMTKNQVSLTCLVKGFYPSDIAVEWESNGQPENNYKTTPPMLDSDGS
FFLYSKLTVDKSRWQQGNVFSCSVMHEALHNHYTQKSLSLSPG

SEQ ID NO. 2
MPPPRLLFFLLFLTPMEVRPEEPLVVKVEEGDNAVLQCLKGTSDGPTQQLTWSRESPLKP
FLKLSLGLPGLGIHMRPLAIWLFIFNVSQQMGGFYLCQPGPPSEKAWQPGWTVNVEGSGG
GGSGGGGSGGGGSDIQMTQSPSSLSASVGDRVTITCQASQDISNYLNWYQQKPGKAPKLL
IYDASNLETGVPSRFSGSGSGTDFTFTISSLQPEDIATYFCQHFDHLPLAFGGGTKVEIK
RTVAAPSVFIFPPSDEQLKSGTASVVCLLNNFYPREAKVQWKVDNALQSGNSQESVTEQD
SKDSTYSLSSTLTLSKADYEKHKVYACEVTHQGLSSPVTKSFNRGEC

SEQ ID NO. 3
MPPPRLLFFLLFLTPMEVRPEEPLVVKVEEGDNAVLQCLKGTSDGPTQQLTWSRESPLKP
FLKLSLGLPGLGIHMRPLAIWLFIFNVSQQMGGFYLCQPGPPSEKAWQPGWTVNVEGSGG
GGSGGGGSGGGGSQVQLQESGPGLVKPSETLSLTCTVSGGSVSSGDYYWTWIRQSPGKGL
EWIGHIYYSGNTNYNPSLKSRLTISIDTSKTQFSLKLSSVTAADTAIYYCVRDRVTGAFD
IWGQGTMVTVSSASTKGPSVFPLAPCSRSTSESTAALGCLVKDYFPEPVTVSWNSGALTS
GVHTFPAVLQSSGLYSLSSVVTVPSSNFGTQTYTCNVDHKPSNTKVDKTVERKCCVECPP
CPAPPVAGPSVFLFPPKPKDTLMISRTPEVTCVVVDVSHEDPEVQFNWYVDGVEVHNAKT
KPREEQFQSTFRVVSVLTVVHQDWLNGKEYKCKVSNKGLPAPIEKTISKTKGQPREPQVY
TLPPSREEMTKNQVSLTCLVKGFYPSDIAVEWESNGQPENNYKTTPPMLDSDGSFFLYSK
LTVDKSRWQQGNVFSCSVMHEALHNHYTQKSLSLSPG

SEQ ID NO. 4
METDTLLLWVLLLWVPGSTGDIQMTQSPSSLSASVGDRVTITCQASQDISNYLNWYQQKP
GKAPKLLIYDASNLETGVPSRFSGSGSGTDFTFTISSLQPEDIATYFCQHFDHLPLAFGG
GTKVEIKRTVAAPSVFIFPPSDEQLKSGTASVVCLLNNFYPREAKVQWKVDNALQSGNSQ
ESVTEQDSKDSTYSLSSTLTLSKADYEKHKVYACEVTHQGLSSPVTKSFNRGEC

SEQ ID NO. 5
METDTLLLWVLLLWVPGSTGDIQMTQSPSSLSASVGDRVTITCQASQDISNYLNWYQQKP
GKAPKLLIYDASNLETGVPSRFSGSGSGTDFTFTISSLQPEDIATYFCQHFDHLPLAFGG
GTKVEIKRTVAAPSVFIFPPSDEQLKSGTASVVCLLNNFYPREAKVQWKVDNALQSGNSQ
ESVTEQDSKDSTYSLSSTLTLSKADYEKHKVYACEVTHQGLSSPVTKSFNRGECDKTHTS
PPSPAPEAAGGPSEVRPEEPLVVKVEEGDNAVLQCLKGTSDGPTQQLTWSRESPLKPFLK
LSLGLPGLGIHMRPLAIWLFIFNVSQQMGGFYLCQPGPPSEKAWQPGWTVNVEGSG

SEQ ID NO. 6
MEFGLSWVFLVALFRGVQCQVQLQESGPGLVKPSETLSLTCTVSGGSVSSGDYYWTWIRQ
SPGKGLEWIGHIYYSGNTNYNPSLKSRLTISIDTSKTQFSLKLSSVTAADTAIYYCVRDR
VTGAFDIWGQGTMVTVSSASTKGPSVFPLAPCSRSTSESTAALGCLVKDYFPEPVTVSWN
SGALTSGVHTFPAVLQSSGLYSLSSVVTVPSSNFGTQTYTCNVDHKPSNTKVDKTVERKC
CVECPPCPAPPVAGPSVFLFPPKPKDTLMISRTPEVTCVVVDVSHEDPEVQFNWYVDGVE
VHNAKTKPREEQFQSTFRVVSVLTVVHQDWLNGKEYKCKVSNKGLPAPIEKTISKTKGQP
REPQVYTLPPSREEMTKNQVSLTCLVKGFYPSDIAVEWESNGQPENNYKTTPPMLDSDGS
FFLYSKLTVDKSRWQQGNVFSCSVMHEALHNHYTQKSLSLSPGGGGGSGGGGSGGGGSEV
```

RPEEPLVVKVEEGDNAVLQCLKGTSDGPTQQLTWSRESPLKPFLKLSLGLPGLGIHMRPL

AIWLFIFNVSQQMGGFYLCQPGPPSEKAWQPGWTVNVEGSG

SEQ ID NO. 7

MEFGLSWVFLVALFRGVQCQVQLVQSGAEVKKPGASVKVSCKASGYTFTDYYMHWVRQAP

GQGLEWMGRVNPNRRGTTYNQKFEGRVTMTTDTSTSTAYMELRSLRSDDTAVYYCARANW

LDYWGQGTTVTVSSASTKGPSVFPLAPCSRSTSESTAALGCLVKDYFPEPVTVSWNSGAL

TSGVHTFPAVLQSSGLYSLSSVVTVPSSSLGTKTYTCNVDHKPSNTKVDKRVESKYGPPC

PPCPAPEAAGGPSVFLFPPKPKDTLMISRTPEVTCVVVDVSQEDPEVQFNWYVDGVEVHN

AKTKPREEQFNSTYRVVSVLTVLHQDWLNGKEYKCKVSNKGLPSSIEKTISKAKGQPREP

QVYTLPPSQEEMTKNQVSLTCLVKGFYPSDIAVEWESNGQPENNYKTTPPVLDSDGSFFL

YSRLTVDKSRWQEGNVFSCSVMHEALHNHYTQKSLSLSLG

SEQ ID NO. 8

MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGG

GGSGGGGSGGGGSDIQMTQSPSSLSASVGDRVTITCSVSSSVSSIYLHWYQQKPGKAPKL

LIYSTSNLASGVPSRFSGSGSGTDFTLTISSLQPEDFATYYCQVYSGYPLTFGGGTKVEI

KRTVAAPSVFIFPPSDEQLKSGTASVVCLLNNFYPREAKVQWKVDNALQSGNSQESVTEQ

DSKDSTYSLSSTLTLSKADYEKHKVYACEVTHQGLSSPVTKSFNRGEC

SEQ ID NO. 9

MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGG

GGSGGGGSGGGGSQVQLVQSGAEVKKPGASVKVSCKASGYTFTDYYMHWVRQAPGQGLEW

MGRVNPNRRGTTYNQKFEGRVTMTTDTSTSTAYMELRSLRSDDTAVYYCARANWLDYWGQ

GTTVTVSSASTKGPSVFPLAPCSRSTSESTAALGCLVKDYFPEPVTVSWNSGALTSGVHT

FPAVLQSSGLYSLSSVVTVPSSSLGTKTYTCNVDHKPSNTKVDKRVESKYGPPCPPCPAP

EAAGGPSVFLFPPKPKDTLMISRTPEVTCVVVDVSQEDPEVQFNWYVDGVEVHNAKTKPR

EEQFNSTYRVVSVLTVLHQDWLNGKEYKCKVSNKGLPSSIEKTISKAKGQPREPQVYTLP

PSQEEMTKNQVSLTCLVKGFYPSDIAVEWESNGQPENNYKTTPPVLDSDGSFFLYSRLTV

DKSRWQEGNVFSCSVMHEALHNHYTQKSLSLSL

SEQ ID NO. 10

METDTLLLWVLLLWVPGSTGDIQMTQSPSSLSASVGDRVTITCSVSSSVSSIYLHWYQQK

PGKAPKLLIYSTSNLASGVPSRFSGSGSGTDFTLTISSLQPEDFATYYCQVYSGYPLTFG

GGTKVEIKRTVAAPSVFIFPPSDEQLKSGTASVVCLLNNFYPREAKVQWKVDNALQSGNS

QESVTEQDSKDSTYSLSSTLTLSKADYEKHKVYACEVTHQGLSSPVTKSFNRGEC

SEQ ID NO. 11

METDTLLLWVLLLWVPGSTGDIQMTQSPSSLSASVGDRVTITCSVSSSVSSIYLHWYQQK

PGKAPKLLIYSTSNLASGVPSRFSGSGSGTDFTLTISSLQPEDFATYYCQVYSGYPLTFG

GGTKVEIKRTVAAPSVFIFPPSDEQLKSGTASVVCLLNNFYPREAKVQWKVDNALQSGNS

QESVTEQDSKDSTYSLSSTLTLSKADYEKHKVYACEVTHQGLSSPVTKSFNRGECDKTHT

SPPSPAPEAAGGPSEVRPEEPLVVKVEEGDNAVLQCLKGTSDGPTQQLTWSRESPLKPFL

KLSLGLPGLGIHMRPLAIWLFIFNVSQQMGGFYLCQPGPPSEKAWQPGWTVNVEGSG

SEQ ID NO. 12
MEFGLSWVFLVALFRGVQCQVQLVQSGAEVKKPGASVKVSCKASGYTFTDYYMHWVRQAP
GQGLEWMGRVNPNRRGTTYNQKFEGRVTMTTDTSTSTAYMELRSLRSDDTAVYYCARANW
LDYWGQGTTVTVSSASTKGPSVFPLAPCSRSTSESTAALGCLVKDYFPEPVTVSWNSGAL
TSGVHTFPAVLQSSGLYSLSSVVTVPSSSLGTKTYTCNVDHKPSNTKVDKRVESKYGPPC
PPCPAPEAAGGPSVFLFPPKPKDTLMISRTPEVTCVVVDVSQEDPEVQFNWYVDGVEVHN
AKTKPREEQFNSTYRVVSVLTVLHQDWLNGKEYKCKVSNKGLPSSIEKTISKAKGQPREP
QVYTLPPSQEEMTKNQVSLTCLVKGFYPSDIAVEWESNGQPENNYKTTPPVLDSDGSFFL
YSRLTVDKSRWQEGNVFSCSVMHEALHNHYTQKSLSLSLGGGGSGGGGSGGGGSEVRPE
EPLVVKVEEGDNAVLQCLKGTSDGPTQQLTWSRESPLKPFLKLSLGLPGLGIHMRPLAIW
LFIFNVSQQMGGFYLCQPGPPSEKAWQPGWTVNVEGSG

SEQ ID NO. 13
METDTLLLWVLLLWVPGSTGDIQMTQTTSSLSASLGDRVTISCRASQDISKYLNWYQQKP
DGTVKLLIYHTSRLHSGVPSRFSGSGSGTDYSLTISNLEQEDIATYFCQQGNTLPYTFGG
GTKLEITGGGGSGGGGSGGGGSGGGGSEVKLQESGPGLVAPSQSLSVTCTVSGVSLPDYG
VSWIRQPPRKGLEWLGVIWGSETTYYNSALKSRLTIIKDNSKSQVFLKMNSLQTDDTAIY
YCAKHYYYGGSYAMDYWGQGTSVTVSSPSQFRVSPLDRTWNLGETVELKCQVLLSNPTSG
CSWLFQPRGAAASPTFLLYLSQNKPKAAEGLDTQRFSGKRLGDTFVLTLSDFRRENEGYY
FCSALSNSIMYFSHFVPVFLPAKPTTTPAPRPPTPAPTIASQPLSLRPEACRPAAGGAVH
TRGLDFACDIYIWAPLAGTCGVLLLSLVITRSKRSRLLHSDYMNMTPRRPGPTRKHYQPY
APPRDFAAYRSKRGRKKLLYIFKQPFMRPVQTTQEEDGCSCRFPEEEEGGCELRVKFSRS
ADAPAYQQGQNQLYNELNLGRREEYDVLDKRRGRDPEMGGKPQRRKNPQEGLYNELQKDK
MAEAYSEIGMKGERRRGKGHDGLYQGLSTATKDTYDALHMQALPPR

SEQ ID NO. 14
MPPPRLLFFLLFLTPMEVRPEEPLVVKVEEGDNAVLQCLKGTSDGPTQQLTWSRESPLKP
FLKLSLGLPGLGIHMRPLAIWLFIFNVSQQMGGFYLCQPGPPSEKAWQPGWTVNVEGSGH
HHHHH

SEQ ID NO. 15
MPPPRLLFFLLFLTPMEVRPEEPLVVKVEEGDNAVLQCLKGTSDGPTQQLTWSRESPLKP
FLKLSLGLPGLGIHMRPLAIWLFIFNVSQQMGGFYLCQPGPPSEKAWQPGWTVNVEGSGD
KTHTCPPCPAPELLGGPSVFLFPPKPKDTLMISRTPEVTCVVVDVSHEDPEVKFNWYVDG
VEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSD
GSFFLYSKLTVDKSRWQQGNVFSCSVMHEALHNHYTQKSLSLSPG

SEQ ID NO. 16
MEFGLSWVFLVALFRGVQCEVQLVESGGGLVQPGGSLRLSCAASGFNIKDTYIHWVRQAP
GKGLEWVARIYPTNGYTRYADSVKGRFTISADTSKNTAYLQMNSLRAEDTAVYYCSRWGG
DGFYAMDYWGQGTLVTVSSASTGGGGSGGGGSGGGGSDIQMTQSPSSLSASVGDRVTITC
RASQDVNTAVAWYQQKPGKAPKLLIYSASFLYSGVPSRFSGSRSGTDFTLTISSLQPEDF
ATYYCQQHYTTPPTFGQGTKVEIKRTGPHHHHHH

SEQ ID NO. 17
MEFGLSWVFLVALFRGVQCQVQLVQSGAEDKKPGESVKISCKASGYTFTNYGMNWVRQAP
GQGLKWMGWINTYTGESTYADDFKGRFAFSLDTSASTAYLQLSSLRGEDTAVYFCARFAI

-continued

KGDYWGQGTTVTVSSASTGGGGSGGGGSGGGGSGGGGSDIVMTQSPLSLEVSPGEPASIS

CRSTKSLLHSDGITYLYWYLQKPGQSPQLLIYQLSNLASGVPDRFSSSGSGTDFTLKISR

VEAEDEGTYYCAQNLEIPRTFGQGTKLEIKRTGPHHHHHH

SEQ ID NO. 18
METDTLLLWVLLLWVPGSTGDIVMTQSPLSLPVTPGEPASISCRSTKSLLHSDGITYLYW

YLQKPGQSPQLLIYQLSNLASGVPDRFSSSGSGTDFTLKISRVEAEDEGVYYCAQNLEIP

RTFGCGTKLEIKRTGGGGSGGGGSGGGGSGGGGSQVQLVQSGAEVKKPGESVKISCKASG

YTFTNYGMNWVRQAPGQCLKWMGWINTYTGESTYADDFKGRFAFSLDTSASTAYLQLSSL

RSEDTAVYFCARFAIKGDYWGQGTLVTVSSGPHHHHHH

SEQ ID NO. 19
MEFGLSWVFLVALFRGVQCQVQLVQSGAEDVKPDASVKLSCKASGYTFTDYYMHWVRQAP

GQGLEWMGRVNPNRRGTTYNQKFEGRVTMTTDTSTSTAYMQLSSLRGEDTAVYYCARANW

LDYWGQGTTVTVSSASTGGGGSGGGGSGGGGSGGGGSDIQMTQSPSSLEASVGDRVTITC

SVSSSVSSIYLHWYQQKPGKSPKLLIYSTSNLASGVPDRFSGSGSGTDFTLTISSLQAED

EGTYYCQVYSGYPLTFGGGTKLEIKRTGPHHHHHH

SEQ ID NO. 20
METDTLLLWVLLLWVPGSTGDIQMTQSPSSLSASVGDRVTITCSVSSSVSSIYLHWYQQK

PGKAPKLLIYSTSNLASGVPSRFSGSGSGTDFTLTISSLQPEDEATYYCQVYSGYPLTFG

CGTKVEIKRTGGGGSGGGGSGGGGSGGGGSQVQLVQSGAEDKKPGASVKVSCKASGYTFT

DYYMHWVRQAPGQCLEWMGRVNPNRRGTTYNQKFEGRVTMTTDTSTSTAYMELRSLRSDD

TAVYYCARANWLDYWGQGTTVTVSSGPHHHHHH

SEQ ID NO. 21
MEFGLSWVFLVALFRGVQCQVQLQESGPGDVKPSETLSLTCTVSGGSVSSGDYYWTWIRQ

SPGKGLEWIGHIYYSGNTNYNPSLKSRLTISIDTSKTTFSLQLSSVTGEDTAIYYCVRDR

VTGAFDIWGQGTTVTVSSASTGGGGSGGGGSGGGGSGGGGSDIQMTQSPSSLEASVGDRV

TITCQASQDISNYLNWYQQKPGKSPKLLIYDASNLETGVPDRFSGSGSGTDFTFTISSLQ

AEDEGTYFCQHFDHLPLAFGGGTKLEIKRTGPHHHHHH

SEQ ID NO. 22
METDTLLLWVLLLWVPGSTGDIQMTQSPSSLSASVGDRVTITCQASQDISNYLNWYQQKP

GKAPKLLIYDASNLETGVPSRFSGSGSGTDFTFTISSLQPEDEATYFCQHFDHLPLAFGC

GTKVEIKRTGGGGSGGGGSGGGGSGGGGSQVQLQESGPGDVKPSETLSLTCTVSGGSVSS

GDYYWTWIRQSPGKCLEWIGHIYYSGNTNYNPSLKSRLTISIDTSKTQFSLKLSSVTAAD

TAIYYCVRDRVTGAFDIWGQGTTVTVSSGPHHHHHH

SEQ ID NO. 23
MPPPRLLFFLLFLTPMEVRHHHHHHPEEPLVVKVEEGDNAVLQCLKGTSDGPTQQLTWSR

ESPLKPFLKLSLGLPGLGIHMRPLAIWLFIFNVSQQMGGFYLCQPGPPSEKAWQPGWTVN

VEGSGELFRWNVSDLGGLGCGLKNRSSEGPSSPSGKLMSPKLYVWAKDRPEIWEGEPPCL

PPRDSLNQSLSQDLTMAPGSTLWLSCGVPPDSVSRGPLSWTHVHPKGPKSLLSLELKDDR

PARDMWVMETGLLLPRATAQDAGKYYCHRGNLTMSFHLEITARPGGGGSGGGGSGGGGSV

RSSSRTPSDKPVAHVVANPQAEGQLQWLNRRANALLANGVELRDNQLVVPSEGLYLIYSQ

VLFKGQGCPSTHVLLTHTISRIAVSYQTKVNLLSAIKSPCQRETPEGAEAKPWYEPIYLG

GVFQLEKGDRLSAEINRPDYLDFAESGQVYFGIIAL

-continued

SEQ ID NO. 24
MEFGLSWVFLVALFRGVQCEVQLVESGGGLVQPGGSLRLSCAASGFNIKDTYIHWVRQAP
GKGLEWVARIYPTNGYTRYADSVKGRFTISADTSKNTAYLQMNSLRAEDTAVYYCSRWGG
DGFYAMDYWGQGTLVTVSSASTGGGGSGGGGSGGGGSDIQMTQSPSSLSASVGDRVTITC
RASQDVNTAVAWYQQKPGKAPKLLIYSASFLYSGVPSRFSGSRSGTDFTLTISSLQPEDF
ATYYCQQHYTTPPTFGQGTKVEIKRTDKTHTSPPSPAPEAAGGPSEVRPEEPLVVKVEEG
DNAVLQCLKGTSDGPTQQLTWSRESPLKPFLKLSLGLPGLGIHMRPLAIWLFIFNVSQQM
GGFYLCQPGPPSEKAWQPGWTVNVEGSGSRGPHHHHHH

SEQ ID NO. 25
MEFGLSWVFLVALFRGVQCEVQLVESGGGLVQPGGSLRLSCAASGFNIKDTYIHWVRQAP
GKGLEWVARIYPTNGYTRYADSVKGRFTISADTSKNTAYLQMNSLRAEDTAVYYCSRWGG
DGFYAMDYWGQGTLVTVSSASTGGGGSGGGGSGGGGSDIQMTQSPSSLSASVGDRVTITC
RASQDVNTAVAWYQQKPGKAPKLLIYSASFLYSGVPSRFSGSRSGTDFTLTISSLQPEDF
ATYYCQQHYTTPPTFGQGTKVEIKRTDKTHTSPPSPAPEAAGGPSEVRPEEPLVVKVEEG
DNAVLQCLKGTSDGPTQQLTWSRESPLKPFLKLSLGLPGLGIHMRPLAIWLFIFNVSQQM
GGFYLCQPGPPSEKAWQPGWTVNVEGSGDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQD
WLNGKEYKCKVSNKALPAPIEKTISKAKGQPREPQVYTLPPSREEMTKNQVSLTCLVKGF
YPSDIAVEWESNGQPENNYKTTPPVLDSDGSFFLYSKLTVDKSRWQQGNVFSCSVMHEAL
HNHYTQKSLSLSPG

SEQ ID NO. 26
MPPPRLLFFLLFLTPMEVRPEEPLVVKVEEGDNAVLQCLKGTSDGPTQQLTWSRESPLKP
FLKLSLGLPGLGIHMRPLAIWLFIFNVSQQMGGFYLCQPGPPSEKAWQPGWTVNVEGSGG
GGGSGGGGSGGGGSGGGGSEVQLVESGGGLVQPGGSLRLSCAASGFNIKDTYIHWVRQAP
GKGLEWVARIYPTNGYTRYADSVKGRFTISADTSKNTAYLQMNSLRAEDTAVYYCSRWGG
DGFYAMDYWGQGTLVTVSSASTGGGGSGGGGSGGGGSDIQMTQSPSSLSASVGDRVTITC
RASQDVNTAVAWYQQKPGKAPKLLIYSASFLYSGVPSRFSGSRSGTDFTLTISSLQPEDF
ATYYCQQHYTTPPTFGQGTKVEIKRTSRGPHHHHHH

SEQ ID NO. 27
MPPPRLLFFLLFLTPMEVRPEEPLVVKVEEGDNAVLQCLKGTSDGPTQQLTWSRESPLKP
FLKLSLGLPGLGIHMRPLAIWLFIFNVSQQMGGFYLCQPGPPSEKAWQPGWTVNVEGSGG
GGGSGGGGSGGGGSGGGGSEVQLVESGGGLVQPGGSLRLSCAASGFNIKDTYIHWVRQAP
GKGLEWVARIYPTNGYTRYADSVKGRFTISADTSKNTAYLQMNSLRAEDTAVYYCSRWGG
DGFYAMDYWGQGTLVTVSSASTGGGGSGGGGSGGGGSDIQMTQSPSSLSASVGDRVTITC
RASQDVNTAVAWYQQKPGKAPKLLIYSASFLYSGVPSRFSGSRSGTDFTLTISSLQPEDF
ATYYCQQHYTTPPTFGQGTKVEIKRTDKTHTCPPCPAPELLGGPSVFLFPPKPKDTLMIS
RTPEVTCVVVDVSHEDPEVKFNWYVDGVEVHNAKTKPREEQYNSTYRVVSVLTVLHQDWL
NGKEYKCKVSNKALPAPIEKTISKAKGQPREPQVYTLPPSREEMTKNQVSLTCLVKGFYP
SDIAVEWESNGQPENNYKTTPPVLDSDGSFFLYSKLTVDKSRWQQGNVFSCSVMHEALHN
HYTQKSLSLSPG

SEQ ID NO. 28
MPPPRLLFFLLFLTPMEVRPEEPLVVKVEEGDNAVLQCLKGTSDGPTQQLTWSRESPLKP
FLKLSLGLPGLGIHMRPLAIWLFIFNVSQQMGGFYLCQPGPPSEKAWQPGWTVNVEGSGE

-continued

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPHHHHHH

SEQ ID NO. 29
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPDKTHTCPPCPAPELLGGPSVFL

FPPKPKDTLMISRTPEVTCVVVDVSHEDPEVKFNWYVDGVEVHNAKTKPREEQYNSTYRV

VSVLTVLHQDWLNGKEYKCKVSNKALPAPIEKTISKAKGQPREPQVYTLPPSREEMTKNQ

VSLTCLVKGFYPSDIAVEWESNGQPENNYKTTPPVLDSDGSFFLYSKLTVDKSRWQQGNV

FSCSVMHEALHNHYTQKSLSLSPG

SEQ ID NO. 30
MPPPRLLFFLLFLTPMEVRPRDSLNQSLSQDLTMAPGSTLWLSCGVPPDSVSRGPLSWTH

VHPKGPKSLLSLELKDDRPARDMWVMETGLLLPRATAQDAGKYYCHRGNLTMSFHLEITA

RPHHHHHH

SEQ ID NO. 31
MPPPRLLFFLLFLTPMEVRPRDSLNQSLSQDLTMAPGSTLWLSCGVPPDSVSRGPLSWTH

VHPKGPKSLLSLELKDDRPARDMWVMETGLLLPRATAQDAGKYYCHRGNLTMSFHLEITA

RPDKTHTCPPCPAPELLGGPSVFLFPPKPKDTLMISRTPEVTCVVVDVSHEDPEVKFNWY

VDGVEVHNAKTKPREEQYNSTYRVVSVLTVLHQDWLNGKEYKCKVSNKALPAPIEKTISK

AKGQPREPQVYTLPPSREEMTKNQVSLTCLVKGFYPSDIAVEWESNGQPENNYKTTPPVL

DSDGSFFLYSKLTVDKSRWQQGNVFSCSVMHEALHNHYTQKSLSLSPG

SEQ ID NO. 32
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSDIQMTQS

PSSLSASVGDRVTITCQASQDISNYLNWYQQKPGKAPKLLIYDASNLETGVPSRFSGSGS

GTDFTFTISSLQPEDIATYFCQHFDHLPLAFGGGTKVEIKRTVAAPSVFIFPPSDEQLKS

GTASVVCLLNNFYPREAKVQWKVDNALQSGNSQESVTEQDSKDSTYSLSSTLTLSKADYE

KHKVYACEVTHQGLSSPVTKSFNRGEC

SEQ ID NO. 33
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSQVQLQES

GPGLVKPSETLSLTCTVSGGSVSSGDYYWTWIRQSPGKGLEWIGHIYYSGNTNYNPSLKS

RLTISIDTSKTQFSLKLSSVTAADTAIYYCVRDRVTGAFDIWGQGTMVTVSSASTKGPSV

FPLAPCSRSTSESTAALGCLVKDYFPEPVTVSWNSGALTSGVHTFPAVLQSSGLYSLSSV

```
VTVPSSNFGTQTYTCNVDHKPSNTKVDKTVERKCCVECPPCPAPPVAGPSVFLFPPKPKD

TLMISRTPEVTCVVVDVSHEDPEVQFNWYVDGVEVHNAKTKPREEQFQSTFRVVSVLTVV

HQDWLNGKEYKCKVSNKGLPAPIEKTISKTKGQPREPQVYTLPPSREEMTKNQVSLTCLV

KGFYPSDIAVEWESNGQPENNYKTTPPMLDSDGSFFLYSKLTVDKSRWQQGNVFSCSVMH

EALHNHYTQKSLSLSPG
                                                SEQ ID NO. 34
METDTLLLWVLLLWVPGSTGDIQMTQSPSSLSASVGDRVTITCQASQDISNYLNWYQQKP

GKAPKLLIYDASNLETGVPSRFSGSGSGTDFTFTISSLQPEDIATYFCQHFDHLPLAFGG

GTKVEIKRTVAAPSVFIFPPSDEQLKSGTASVVCLLNNFYPREAKVQWKVDNALQSGNSQ

ESVTEQDSKDSTYSLSSTLTLSKADYEKHKVYACEVTHQGLSSPVTKSFNRGECDKTHTS

PPSPAPEAAGGPSPEEPLVVKVEEGDNAVLQCLKGTSDGPTQQLTWSRESPLKPFLKLSL

GLPGLGIHMRPLAIWLFIFNVSQQMGGFYLCQPGPPSEKAWQPGWTVNVEGSGELFRWNV

SDLGGLGCGLKNRSSEGPSSPSGKLMSPKLYVWAKDRPEIWEGEPPCLPPRDSLNQSLSQ

DLTMAPGSTLWLSCGVPPDSVSRGPLSWTHVHPKGPKSLLSLELKDDRPARDMWVMETGL

LLPRATAQDAGKYYCHRGNLTMSFHLEITARP
                                                SEQ ID NO. 35
MEFGLSWVFLVALFRGVQCQVQLQESGPGLVKPSETLSLTCTVSGGSVSSGDYYWTWIRQ

SPGKGLEWIGHIYYSGNTNYNPSLKSRLTISIDTSKTQFSLKLSSVTAADTAIYYCVRDR

VTGAFDIWGQGTMVTVSSASTKGPSVFPLAPCSRSTSESTAALGCLVKDYFPEPVTVSWN

SGALTSGVHTFPAVLQSSGLYSLSSVVTVPSSNFGTQTYTCNVDHKPSNTKVDKTVERKC

CVECPPCPAPPVAGPSVFLFPPKPKDTLMISRTPEVTCVVVDVSHEDPEVQFNWYVDGVE

VHNAKTKPREEQFQSTFRVVSVLTVVHQDWLNGKEYKCKVSNKGLPAPIEKTISKTKGQP

REPQVYTLPPSREEMTKNQVSLTCLVKGFYPSDIAVEWESNGQPENNYKTTPPMLDSDGS

FFLYSKLTVDKSRWQQGNVFSCSVMHEALHNHYTQKSLSLSPGGGGSGGGGSGGGGSPE

EPLVVKVEEGDNAVLQCLKGTSDGPTQQLTWSRESPLKPFLKLSLGLPGLGIHMRPLAIW

LFIFNVSQQMGGFYLCQPGPPSEKAWQPGWTVNVEGSGELFRWNVSDLGGLGCGLKNRSS

EGPSSPSGKLMSPKLYVWAKDRPEIWEGEPPCLPPRDSLNQSLSQDLTMAPGSTLWLSCG

VPPDSVSRGPLSWTHVHPKGPKSLLSLELKDDRPARDMWVMETGLLLPRATAQDAGKYYC

HRGNLTMSFHLEITARP
                                                SEQ ID NO. 36
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSDIQMTQS

PSSLSASVGDRVTITCSVSSSVSSIYLHWYQQKPGKAPKLLIYSTSNLASGVPSRFSGSG

SGTDFTLTISSLQPEDFATYYCQVYSGYPLTFGGGTKVEIKRTVAAPSVFIFPPSDEQLK

SGTASVVCLLNNFYPREAKVQWKVDNALQSGNSQESVTEQDSKDSTYSLSSTLTLSKADY

EKHKVYACEVTHQGLSSPVTKSFNRGEC
                                                SEQ ID NO. 37
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE
```

-continued

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSDIQMTQS

GAEVKKPGASVKVSCKASGYTFTDYYMHWVRQAPGQGLEWMGRVNPNRRGTTYNQKFEGR

VTMTTDTSTSTAYMELRSLRSDDTAVYYCARANWLDYWGQGTTVTVSSASTKGPSVFPLA

PCSRSTSESTAALGCLVKDYFPEPVTVSWNSGALTSGVHTFPAVLQSSGLYSLSSVVTVP

SSSLGTKTYTCNVDHKPSNTKVDKRVESKYGPPCPPCPAPEAAGGPSVFLFPPKPKDTLM

ISRTPEVTCVVVDVSQEDPEVQFNWYVDGVEVHNAKTKPREEQFNSTYRVVSVLTVLHQD

WLNGKEYKCKVSNKGLPSSIEKTISKAKGQPREPQVYTLPPSQEEMTKNQVSLTCLVKGF

YPSDIAVEWESNGQPENNYKTTPPVLDSDGSFFLYSRLTVDKSRWQEGNVFSCSVMHEAL

HNHYTQKSLSLSL

SEQ ID NO. 38

METDTLLLWVLLLWVPGSTGDIQMTQSPSSLSASVGDRVTITCSVSSSVSSIYLHWYQQK

PGKAPKLLIYDASNLETGVPSRFSGSGSGTDFTFTISSLQPEDIATYFCQHFDHLPLAFG

GGTKVEIKRTVAAPSVFIFPPSDEQLKSGTASVVCLLNNFYPREAKVQWKVDNALQSGNS

QESVTEQDSKDSTYSLSSTLTLSKADYEKHKVYACEVTHQGLSSPVTKSFNRGECDKTHT

SPPSPAPEAAGGPSPEEPLVVKVEEGDNAVLQCLKGTSDGPTQQLTWSRESPLKPFLKLS

LGLPGLGIHMRPLAIWLFIFNVSQQMGGFYLCQPGPPSEKAWQPGWTVNVEGSGELFRWN

VSDLGGLGCGLKNRSSEGPSSPSGKLMSPKLYVWAKDRPEIWEGEPPCLPPRDSLNQSLS

QDLTMAPGSTLWLSCGVPPDSVSRGPLSWTHVHPKGPKSLLSLELKDDRPARDMWVMETG

LLLPRATAQDAGKYYCHRGNLTMSFHLEITARP

SEQ ID NO. 39

MEFGLSWVFLVALFRGVQCQVQLVQSGAEDVKPDASVKLSCKASGYTFTDYYMHWVRQAP

GQGLEWMGRVNPNRRGTTYNQKFEGRVTMTTDTSTSTAYMQLSSLRGEDTAVYYCARANW

LDYWGQGTTVTVSSASTKGPSVFPLAPCSRSTSESTAALGCLVKDYFPEPVTVSWNSGAL

TSGVHTFPAVLQSSGLYSLSSVVTVPSSSLGTKTYTCNVDHKPSNTKVDKRVESKYGPPC

PPCPAPEAAGGPSVFLEPPKPKDTLMISRTPEVTCVVVDVSQEDPEVQFNWYVDGVEVHN

AKTKPREEQFNSTYRVVSVLTVLHQDWLNGKEYKCKVSNKGLPSSIEKTISKAKGQPREP

QVYTLPPSREEMTKNQVSLTCLVKGFYPSDIAVEWESNGQPENNYKTTPPMLDSDGSFFL

YSRLTVDKSRWQEGNVFSCSVMHEALHNHYTQKSLSLSLGGGGGSGGGGSGGGGSPEEPL

VVKVEEGDNAVLQCLKGTSDGPTQQLTWSRESPLKPFLKLSLGLPGLGIHMRPLAIWLFI

FNVSQQMGGFYLCQPGPPSEKAWQPGWTVNVEGSGELFRWNVSDLGGLGCGLKNRSSEGP

SSPSGKLMSPKLYVWAKDRPEIWEGEPPCLPPRDSLNQSLSQDLTMAPGSTLWLSCGVPP

DSVSRGPLSWTHVHPKGPKSLLSLELKDDRPARDMWVMETGLLLPRATAQDAGKYYCHRG

NLTMSFHLEITARP

SEQ ID NO. 40

MEFGLSWVFLVALFRGVQCEVQLVESGGGLVQPGGSLRLSCAASGFNIKDTYIHWVRQAP

GKGLEWVARIYPTNGYTRYADSVKGRFTISADTSKNTAYLQMNSLRAEDTAVYYCSRWGG

DGFYAMDYWGQGTLVTVSSASTGGGGSGGGGSGGGGSDIQMTQSPSSLSASVGDRVTITC

RASQDVNTAVAWYQQKPGKAPKLLIYSASFLYSGVPSRFSGSRSGTDFTLTISSLQPEDF

ATYYCQQHYTTPPTFGQGTKVEIKRTDKTHTSPPSPAPEAAGGPSPEEPLVVKVEEGDNA

VLQCLKGTSDGPTQQLTWSRESPLKPFLKLSLGLPGLGIHMRPLAIWLFIFNVSQQMGGF

-continued

YLCQPGPPSEKAWQPGWTVNVEGSGELFRWNVSDLGGLGCGLKNRSSEGPSSPSGKLMSP

KLYVWAKDRPEIWEGEPPCLPPRDSLNQSLSQDLTMAPGSTLWLSCGVPPDSVSRGPLSW

THVHPKGPKSLLSLELKDDRPARDMWVMETGLLLPRATAQDAGKYYCHRGNLTMSFHLEI

TARPSRGPHHHHHH

SEQ ID NO. 41
MEFGLSWVFLVALFRGVQCEVQLVESGGGLVQPGGSLRLSCAASGFNIKDTYIHWVRQAP

GKGLEWVARIYPTNGYTRYADSVKGRFTISADTSKNTAYLQMNSLRAEDTAVYYCSRWGG

DGFYAMDYWGQGTLVTVSSASTGGGGSGGGGSGGGGSDIQMTQSPSSLSASVGDRVTITC

RASQDVNTAVAWYQQKPGKAPKLLIYSASFLYSGVPSRFSGSRSGTDFTLTISSLQPEDF

ATYYCQQHYTTPPTFGQGTKVEIKRTDKTHTSPPSPAPEAAGGPSPEEPLVVKVEEGDNA

VLQCLKGTSDGPTQQLTWSRESPLKPFLKLSLGLPGLGIHMRPLAIWLFIFNVSQQMGGF

YLCQPGPPSEKAWQPGWTVNVEGSGELFRWNVSDLGGLGCGLKNRSSEGPSSPSGKLMSP

KLYVWAKDRPEIWEGEPPCLPPRDSLNQSLSQDLTMAPGSTLWLSCGVPPDSVSRGPLSW

THVHPKGPKSLLSLELKDDRPARDMWVMETGLLLPRATAQDAGKYYCHRGNLTMSFHLEI

TARPDKTHTCPPCPAPELLGGPSVFLFPPKPKDTLMISRTPEVTCVVVDVSHEDPEVKFN

WYVDGVEVHNAKTKPREEQYNSTYRVVSVLTVLHQDWLNGKEYKCKVSNKALPAPIEKTI

SKAKGQPREPQVYTLPPSREEMTKNQVSLTCLVKGFYPSDIAVEWESNGQPENNYKTTPP

VLDSDGSFFLYSKLTVDKSRWQQGNVFSCSVMHEALHNHYTQKSLSLSPG

SEQ ID NO. 42
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSGGGGSEV

QLVESGGGLVQPGGSLRLSCAASGFNIKDTYIHWVRQAPGKGLEWVARIYPTNGYTRYAD

SVKGRFTISADTSKNTAYLQMNSLRAEDTAVYYCSRWGGDGFYAMDYWGQGTLVTVSSAS

TGGGGSGGGGSGGGGSDIQMTQSPSSLSASVGDRVTITCRASQDVNTAVAWYQQKPGKAP

KLLIYSASFLYSGVPSRFSGSRSGTDFTLTISSLQPEDFATYYCQQHYTTPPTFGQGTKV

EIKRTSRGPHHHHHH

SEQ ID NO. 43
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSGGGGSEV

QLVESGGGLVQPGGSLRLSCAASGFNIKDTYIHWVRQAPGKGLEWVARIYPTNGYTRYAD

SVKGRFTISADTSKNTAYLQMNSLRAEDTAVYYCSRWGGDGFYAMDYWGQGTLVTVSSAS

TGGGGSGGGGSGGGGSDIQMTQSPSSLSASVGDRVTITCRASQDVNTAVAWYQQKPGKAP

KLLIYSASFLYSGVPSRFSGSRSGTDFTLTISSLQPEDFATYYCQQHYTTPPTFGQGTKV

EIKRTDKTHTCPPCPAPELLGGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKT

-continued

ISKAKGQPREPQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSPG

SEQ ID NO. 46
MESDESGLPAMEIECRITGTLNGVEFELVGGGEGTPEQGRMTNKMKSTKGALTFSPYLLSHVMGY

GFYHFGTYPSGYENPFLHAINNGGYTNTRIEKYEDGGVLHVSFSYRYEAGRVIGDFKVMGTGFPE

DSVIFTDKIIRSNATVEHLHPMGDNDLDGSFTRTFSLRDGGYYSSVVDSHMHFKSAIHPSILQNG

GPMFAFRRVEEDHSNTELGIVEYQHAFKTPDADAGEERV

SEQ ID NO. 47
MESDESGLPAMEIECRITGTLNGVEFELVGGGEGTPEQGRMTNKMKSTKGALTFSPYLLSHVMGY

GFYHFGTYPSGYENPFLHAINNGGYTNTRIEKYEDGGVLHVSFSYRYEAGRVIGDFKVMGTGFPE

DSVIFTDKIIRSNATVEHLHPMGDNDLDGSFTRTFSLRDGGYYSSVVDSHMHFKSAIHPSILQNG

GPMFAFRRVEEDHSNTELGIVEYQHAFKTPDADAGEERV

SEQ ID NO. 48
MESDESGLPAMEIECRITGTLNGVEFELVGGGEGTPEQGRMTNKMKSTKGALTFSPYLLSHVMGY

GFYHFGTYPSGYENPFLHAINNGGYTNTRIEKYEDGGVLHVSFSYRYEAGRVIGDFKVMGTGFPE

DSVIFTDKIIRSNATVEHLHPMGDNDLDGSFTRTFSLRDGGYYSSVVDSHMHFKSAIHPSILQNG

GPMFAFRRVEEDHSNTELGIVEYQHAFKTPDADAGEERV

SEQ ID NO. 49
MESDESGLPAMEIECRITGTLNGVEFELVGGGEGTPEQGRMTNKMKSTKGALTFSPYLLSHVMGY

GFYHFGTYPSGYENPFLHAINNGGYTNTRIEKYEDGGVLHVSFSYRYEAGRVIGDFKVMGTGFPE

DSVIFTDKIIRSNATVEHLHPMGDNDLDGSFTRTFSLRDGGYYSSVVDSHMHFKSAIHPSILQNG

GPMFAFRRVEEDHSNTELGIVEYQHAFKTPDADAGEERV

SEQ ID NO. 50
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKTYCHRGNLTMSFHLEITARPVLWHWLLRTGGWKGGGGSGGGG

SGGGGSGGGGSQVQLQESGPGLVKPSETLSLTCTVSGGSVSSGDYYWTWIRQSPGKGLEW

IGHIYYSGNTNYNPSLKSRLTISIDTSKTQFSLKLSSVTAADTAIYYCVRDRVTGAFDIW

GQGTMVTVSSASTKGPSVFPLAPCSRSTSESTAALGCLVKDYFPEPVTVSWNSGALTSGV

HTFPAVLQSSGLYSLSSVVTVPSSNFGTQTYTCNVDHKPSNTKVDKTVERKCCVECPPCP

APPVAGPSVFLFPPKPKDTLMISRTPEVTCVVVDVSHEDPEVQFNWYVDGVEVHNAKTKP

REEQFQSTFRVVSVLTVVHQDWLNGKEYKCKVSNKGLPAPIEKTISKTKGQPREPQVYTL

PPSREEMTKNQVSLTCLVKGFYPSDIAVEWESNGQPENNYKTTPPMLDSDGSFFLYSKLT

VDKSRWQQGNVFSCSVMHEALHNHYTQKSLSLSPG

SEQ ID NO. 51
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKTYCHRGNLTMSFHLEITARPVLWHWLLRTGGWKGGGGSGGGG

SGGGGSGGGGSQVQLVQSGAEDVKPDASVKLSCKASGYTFTDYYMHWVRQAPGQGLEWMG

```
RVNPNRRGTTYNQKFEGRVTMTTDTSTSTAYMQLSSLRGEDTAVYYCARANWLDYWGQGT

TVTVSSASTKGPSVFPLAPCSRSTSESTAALGCLVKDYFPEPVTVSWNSGALTSGVHTFP

AVLQSSGLYSLSSVVTVPSSSLGTKTYTCNVDHKPSNTKVDKRVESKYGPPCPPCPAPEA

AGGPSVFLFPPKPKDTLMISRTPEVTCVVVDVSQEDPEVQFNWYVDGVEVHNAKTKPREE

QFNSTYRVVSVLTVLHQDWLNGKEYKCKVSNKGLPSSIEKTISKAKGQPREPQVYTLPPS

QEEMTKNQVSLTCLVKGFYPSDIAVEWESNGQPENNYKTTPPVLDSDGSFFLYSRLTVDK

SRWQEGNVFSCSVMHEALHNHYTQKSLSLSL

SEQ ID NO. 52
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKTYCHRGNLTMSFHLEITARPVLWHWLLRTGGWKGGGGSGGGG

SGGGGSGGGGSQVQLVQSGAEDVKPDASVKLSCKASGYTFTDYYMHWVRQAPGQGLEWMG

RVNPNRRGTTYNQKFEGRVTMTTDTSTSTAYMQLSSLRGEDTAVYYCARANWLDYWGQGT

TTVTVSSASTSGGGSGGGSSGGSGSGGGGSDIVMTQSPLSLEVSPGEPASISCRSTKSLL

HSDGITYLYWYLQKPGQSPQLLIYQLSNLASGVPDRFSSSGSGTDFTLKISRVEAEDEGT

YYCAQNLEIPRTFGQGTKLEIKRTHHHHHH

SEQ ID NO. 53
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKTYCHRGNLTMSFHLEITARPVLWHWLLRTGGWKGGGGSGGGG

SGGGGSGGGGSQVQLVQSGAEDVKPDASVKLSCKASGYTFTDYYMHWVRQAPGQGLEWMG

RVNPNRRGTTYNQKFEGRVTMTTDTSTSTAYMQLSSLRGEDTAVYYCARANWLDYWGQGT

TVTVSSASTGGGGSGGGGSGGGGSGGGGSDIQMTQSPSSLEASVGDRVTITCSVSSSVSS

IYLHWYQQKPGKSPKLLIYSTSNLASGVPDRFSGSGSGTDFTLTISSLQAEDEGTYYCQV

YSGYPLTYGGGTKLEIKRTHHHHHH

SEQ ID NO. 54
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKTYCHRGNLTMSFHLEITARPVLWHWLLRTGGWKGGGGSGGGG

SGGGGSGGGGSQVQLQESGPGLVKPSETLSLTCTVSGGSVSSGDYYWTWIRQSPGKGLEW

IGHIYYSGNTNYNPSLKSRLTISIDTSKTQFSLKLSSVTAADTAIYYCVRDRVTGAFDIW

GQGTTVTVSSASTGGGGSGGGGSGGGGSGGGGSDIQMTQSPSSLEASVGDRVTITCQASQ

DISNYLNWYQQKPGKSPKLLIYDASNLETGVPDRFSGSGEGTDFTFTISSLQAEDEGTYF

CQHFDHLPLAFGGGTKLEIKRTHHHHHH

SEQ ID NO. 55
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE
```

-continued

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKTYCHRGNLTMSFHLEITARPVLWHWLLRTGGWKGGGGSGGGG

SGGGGSGGGGSEVQLVESGGGLVQPGGSLRLSCAASGFNIKDTYIHWVRQAPGKGLEWVA

RIYPTNGYTRYADSVKGRFTISADTSKNTAYLQMNSLRAEDTAVYYCSRWGGDOFYAMDY

WGQGTLVTVSSASTSGGGSGGGSSGGGSGSDIQMTQSPSSLSASVGDRVTITCRASQDVNT

AVAWYQQKPGKAPKLLIYSASFLYSGVPSRFSGSRSGTDFTLTISSLQPEDFATYYCQQH

YTTPPTFGQGTKVEIKRTHHHHHH

SEQ ID NO. 56
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKTYCHRGNLTMSFHLEITARPVLWHWLLRTGGWKDKTHTCPPC

PAPELLGGPSVFLFPPKPKDTLMISRTPEVTCVVVDVSHEDPEVKFNWYVDGVEVHNAKT

KPREEQYNSTYRVVSVLTVLHQDWLNGKEYKCKVSNKALPAPIEKTISKAKGQPREPQVY

TLPPSREEMTKNQVSLTCLVKGFYPSDIAVEWESNGQPENNYKTTPPVLDSDGSFFLYSK

LTVDKSRWQQGNVFSCSVMHEALHNHYTQKSLSLSPGGGGSGGGGSGGGGSGGGGSEVQ

LVESGGGLVQPGGSLRLSCAASCFNIKDTYIHWVRQAPGKGLEWVARIYPTNGYTRYADS

VKGRFTISADTSKNTAYLQMNSLRAEDTAVYYCSRWGGDGFYAMDYWGQGTLVTVSSAST

GGGGSGGGGSGGGGSDIQMTQSPSSLSASVGDRVTITCRASQDVNTAVAWYQQKPGKAPK

LLIYSASFLYSGVPSRFSGSRSGTDFTLTISSLQPEDFATYYCQQHYTTPPTFGQGTKVE

IKRT

SEQ ID NO. 57
MELAALCRWSLLLALLPPGAASTQVCTGTDMKLRLPASPETHLDMLRHLYQGCQVVQGNL

ELTYLPTNASLSFLQDIQEVQGYVLIAHNQVRQVPLQRLRIVRGTQLFEDNYALAVLDNG

DPLNNTTPVTGASPGGLRELQLRSLTEILKGGVLIQRNPQLCYQDTILWKDIFHKNNQLA

LTLIDTNRSRACHPCSPMCKGSRCWGESSEDCQSLTRTVCAGGCARCKGPLPTDCCHEQC

AAGCTGPKHSDCLACLHFNHSGICELHCPALVTYNTDTFESMPNPEGRYTFGASCVTACP

YNYLSTDVGSCTLVCPLHNQEVTAEDGTQRCEKCSKPCARVCYGLGMEHLREVRAVTSAN

IQEFAGCKKIFGSLAFLPESFDGDPASNTAPLQPEQLQVFETLEEITGYLYISAWPDSLP

DLSVFQNLQVIRGRILHNGAYSLTLQGLGISWLGLRSLRELGSGLALIHHNTHLCFVHTV

PWDQLFRNPHQALLHTANRPEDECVGEGLACHQLCARGHCWGPGPTQCVNCSQFLRGQEC

VEECRVLQGLPREYVNARHCLPCHPECQPQNGSVTCFGPEADQCVACAHYKDPPFCVARC

PSGVKPDLSYMPIWKFPDEEGACQPCPINCTHSCVDLDDKGCPAEQRASPLTSGGGSGGG

GSGGGGSGGGGSQVQLQESGPGDVKPSETLSLTCTVSGGSVSSGDYYWTWIRQSPGKGLE

WIGHIYYSGNTNYNPSLKSRLTISIDTSKTTFSLQLSSVTGEDTAIYYCVRDRVTGAFDI

WGQGTTVTVSSASTGGGGSGGGGSGGGGSGGGGSDIQMTQSPSSLEASVGDRVTITCQAS

QDISNYLNWYQQKPGKSPKLLIYDASNLETGVPDRFSGSGSTDFTFTISSLQAEDGTY

FCQHFDHLPLAFGGGTKLEIKRTHHHHHH

SEQ ID NO. 58
MELAALCRWGLLLALLPPGAASNRPEDECVGEGLACHQLCARGHCWGPSPTQCVNCSQFL
RGQECVEECRVLQGLPREYVNARHCLPCHPECQPQNGSVTCFGPEADQCVACAHYKDPPF
CVARCPSGVKPDLSYMPIWKFPDEEGACQPCPINCTHSCVDLDDKGCPAEQRASPLTGGG
GSGGGGSGGGGSGGGGSQVQLQESGPGDVKPSETLSLTCTVSGGSVSSGDYYWTWIRQSP
GKGLEWIGHIYYSGNTNYNPSLKSRLTISIDTSKTTFSLQLSSVTGEDTAIYYCVRDRVT
GAFDIWGQGTTVTVSSASTGGGGSGGGGSGGGGSGGGGSDIQMTQSPSSLEASVGDRVTI
TCQASQDISNYLNWYQQKPGKSPKLLTYDASNLETGVPDRFSGSGSGTDFTFTISSLQAE
DEGTYFCQHFDHLPLAFGGGTKLEIKRTHHHHHH

SEQ ID NO. 63
MPPPRLLFFLLFLTPMEVRPEEPLVVKVEEGDNAVLQCLKGTSDGPTQQLTWSRESPLKP
FLKLSLGLPGLGIHMRPLAIWLFIFNVSQQMGGFYLCQPGPPSEKAWQPGWTVNVEGSGE
LFRWNVSDLGGLGCGLKNRSSEGPSSPSGKLMSPKLYVWAKDRPEIWEGEPPCLPPRDSL
NQSLSQDLTMAPGSTLWLSCGVPPDSVSRGPLSWTHVHPKGPKSLLSLELKDDRPARDMW
VMETGLLLPRATAQDAGKTYCHRGNLTMSFHLEITARPVLWHWLLRTGGWKGGGGSGGGG
SGGGGSGGGGSEVQLQQSGAELVKPGASVKMSCKASGYTFTSYNMHWVKQTPGQGLEWIG
AIYPGNGDTSYNQKFKGKATLTADKSSSTAYMQLSSLTSEDSADYYCARSNYYGSSYWFF
DVWGAGTTVTVSSGSTSGGGSGGGSGGGGSSDIVLTQSPAILSASPGEKVTMTCRASSSV
NYMDWYQKKPGSSPKPWIYATSNLASGVPARFSGSGSGTSYSLTISRVEAEDAATYYCQQ
WSFNPPTFGGGTKLEIKHHHHHH

SEQ ID NO. 64
MHLLGPWLLLLVLEYLAFSDSSKWVFEHPETLYAWEGACVWIPCTYRALDGDLESFILFH
NPEYNKNTSKFDGTRLYESTKDGKVPSEQKRVQFLGDKNKACTLSIHPVHLNDSGQLGLR
MESKTEKWMERIHLNVSERPFPPHIQLPPEIQESQEVTLTCLLNFSCYGYPIQLQWLLEG
VPMRQAAVTSTSLTIKSVFTRSELKFSPQWSHHGKIVTCQLQDADGKFLSNDTVQLNVKH
TPKLEIKVTPSDAIVREGDSVTMTCEVSSSNPEYTTVSWLKDGTSLKKQNTFTLNLREVT
KDQSGKYCCQVSNDVGPGRSEEVFLQVQYAPEGGGGSGGGGSGGGGSGGGGSDIQMTQTT
SSLSASLGDRVTISCRASQDISKYLNWYQQKPDGTVKLLIYHTSRLHSGVPSRFSGSGSG
TDYSLTISNLEQEDIATYFCQQGNTLPYTFGGGTKLEITGGGGSGGGGSGGGGSGGGGSE
VKLQESGPGLVAPSQSLSVTCTVSGVSLPDYGVSWIRQPPRKGLEWLGVIWGSETTYYNS
ALKSRLTIIKDNSKSQVFLKMNSLQTDDTAIYYCAKHYYYGGSYAMDYWGQGTSVTVSSH
HHHHH

SEQ ID NO. 65
MHLLGPWLLLLVLEYLAFSDSSKWVFEHPETLYAWEGACVWIPCTYRALDGDLESFILFH
NPEYNKNTSKFDGTRLYESTKDGKVPSEQKRVQFLGDKNKACTLSIHPVHLNDSGQLGLR
MESKTEKWMERIHLNVSERPFPPHIQLPPEIQESQEVTLTCLLNFSCYGYPIQLQWLLEG
VPMRQAAVTSTSLTIKSVFTRSELKFSPQWSHHGKIVTCQLQDADGKFLSNDTVQLNVKH
TPKLEIKVTPSDAIVREGDSVTMTCEVSSSNPEYTTVSWLKDGTSLKKQNTFTLNLREVT
KDQSGKYCCQVSNDVGPGRSEEVFLQVQYAPEGGGGSGGGGSGGGGSGGGGSEVQLQQSG
AELVKPGASVKMSCKASGYTFTSYNMHWVKQTPGQGLEWIGAIYPGNGDTSYNQKFKGKA
TLTADKSSSTAYMQLSSLTSEDSADYYCARSNYYGSSYWFFDVWGAGTTVTVSSGGGGSG

-continued

GSGGGSGGGGSSDIVLTQSPAILSASPGEKVTMTCRASSSVNYMDWYQKKPGSSPKPWIY

ATSNLASGVPARFSGSGSGTSYSLTISRVEAEDAATYYCQQWSFNPPTFGGGTKLEIKHH

HHHH

SEQ ID NO. 67
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPVLHWLLRTGGWKGGGGSGGGG

SGGGGSGGGSGSDILMTQSPSSMSVSLGDTVSITCHSSQDINSNISWLQQRPSKSFKGLIY

HGTNLDDEVPSRFSGSGSGADYSLTISSLESEDFADYYCVQYAQFPWTFGGGTKLEIKRG

GGGSGGGGSGGGGSGGGGSMRVLILLWLFTAFPGVLSDVQLQESGPSLVKPSQSLSLTCT

VTGYSITSDFAWNWIRQFPGNKLEWMGYISYSGNTRYNPSLKSRISITRDTSKNQFFLQL

NSVTIEDTATYYCVTAGRGFPYWGQGTLVTVSAHHHHHH

SEQ ID NO. 68
MHLLGPWLLLLVLEYLAFSDSSKWVFEHPETLYAWEGACVWIPCTYRALDGDLESFILFH

NPEYNKNTSKFDGTRLYESTKDGKVPSEQKRVQFLGDKNKACTLSIHPVHLNDSGQLGLR

MESKTEKWMERIHLNVSERPFPPHIQLPPEIQESQEVTLTCLLNFSCYGYPIQLQWLLEG

VPMRQAAVTSTSLTIKSVFTRSELKFSPQWSHHGKIVTCQLQDADGKFLSNDTVQLNVKH

TPKLEIKVTPSDAIVREGDSVTMTCEVSSNPEYTTVSWLKDGTSLKKQNTFTLNLREVT

KDQSGKYCCQVSNDVGPGRSEEVFLQVQYAPEGGGGSGGGGSGGGGSGGGGSDILMTQSP

SSMSVSLGDTVSITCHSSQDINSNIGWLQQRPGKSFKGLIYHGTNLDDEVPSRFSGSGSG

ADYSLTISSLESEDFADYYCVQYAQFPWTFGGGTKLEIKRGGGGSGGGGSGGGGSGGGGS

MRVLILLWLFTAFPGVLSDVQLQESGPSLVKPSQSLSLTCTVTGYSITSDFAWNWIRQFP

GNKLEWMGYISYSGNTRYNPSLKSRISITRDTSKNQFFLQLNSVTIEDTATYYCVTAGRG

FPYWGQGTLVTVSAHHHHHH

SEQ ID NO. 71
MLRLLLALNLFPSIQVTGDIQMTQTTSSLSASLGDRVTISCRASQDISKYLNWYQQKPDG

TVKLLIYHTSRLHSGVPSRFSGSGSGTDYSLTISNLEQEDIATYFCQQGNTLPYTFGGGT

KLEITGGGGSGGGGSGGGGSGGGGSEVKLQESGPGLVAPSQSLSVTCTVSGVSLPDYGVS

WIRQPPRKGLEWLGVIWGSETTYYNSALKSRLTIIKDNSKSQVFLKMNSLQTDDTAIYYC

AKHYYYGGSYAMDYWGQGTSVTVSSDYKDDDDKIEVMYPPPYLDNEKSNGTIIHVKGKHL

CPSPLFPGPSKPFWVLVVVGGVLACYSLLVTVAFIIFWVRSKRSRLLHSDYMNMTPRRPG

PTRKHYQPYAPPRDFAAYRSKRGRKKLLYIFKQPFMRPVQTTQEEDGCSCRFPEEEEGGC

ELRVKFSRSADAPAYQQGQNQLYNELNLGRREEYDVLDKRKGRDPEMGGKPQRRKNPQEG

LYNELQKDKMAEAYSEIGMKGERRRGKGHDGLYQGLSTATKDTYDALHMQALPPR

SEQ ID NO. 72
MLRLLLALNLFPSIQVTGDIQMTQTTSSLSASLGDRVTISCRASQDISKYLNWYQQKPDG

TVKLLIYHTSRLHSGVPSRFSGSGSGTDYSLTISNLEQEDIATYFCQQGNTLPYTFGGGT

KLEITGGGGSGGGGSGGGGSGGGGSEVKLQESGPGLVAPSQSLSVTCTVSGVSLPDYGVS

WIRQPPRKGLEWLGVIWGSETTYYNSALKSRLTIIKDNSKSQVFLKMNSLQTDDTAIYYC

AKHYYYGGSYAMDYWGQGTSVTVSSDYKDDDDKIEVMYPPPYLDNEKSNGTIIHVKGKHL

-continued

CPSPLFPGPSKPFWVLVVVGGVLACYSLLVTVAFIIFWVRSKRSRLLHSDYMNMTPRRPG

PTRKHYQPYAPPRDFAAYRSKRGRKKLLYIFKQPFMRPVQTTQEEDGCSCRFPEEEEGGC

ELRVKFSRSADAPAYQQGQNQLYNELNLGRREEYDVLDKRKGRDPEMGGKPQRRKNPQEG

LYNELQKDKMAEAYSEIGMKGERRRGKGHDGLYQGLSTATKDTYDALHMQALPPR

SEQ ID NO. 73
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGSGGGGSGGGGSGGGGSEV

QLVESGGGLVQPGGSLRLSCAASGFNIKDTYIHWVRQAPGKGLEWVARIYPTNGYTRYAD

SVKGRFTISADTSKNTAYLQMNSLRAEDTAVYYCSRWGGDGFYAMDYWGQGTLVTVSSAS

TGGGGSGGGGSGGGGSDIQMTQSPSSLSASVGDRVTITCRASQDVNTAVAWYQQKPGKAP

KLLIYSASFLYSGVPSRFSGSRSGTDFTLTISSLQPEDFATYYCQQHYTTPPTFGQGTKV

EIKRTHHHHHH

SEQ ID NO. 74
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGSGGGGSGGGGSGGGGSEV

QLVESGGGLVQPGGSLRLSCAASGFNIKDTYIHWVRQAPGKGLEWVARIYPTNGYTRYAD

SVKGRFTISADTSKNTAYLQMNSLRAEDTAVYYCSRWGGDGFYAMDYWGQGTLVTVSSAS

TGGGGSGGGGSGGGGSDIQMTQSPSSLSASVGDRVTITCRASQDVNTAVAWYQQKPGKAP

KLLIYSASFLYSGVPSRFSGSRSGTDFTLTISSLQPEDFATYYCQQHYTTPPTFGQGTKV

EIKRTHHHHHH

SEQ ID NO. 75
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGSGGGGSGGGGSGGGGSEV

QLVESGGGLVQPGGSLRLSCAASGFNIKDTYIHWVRQAPGKGLEWVARIYPTNGYTRYAD

SVKGRFTISADTSKNTAYLQMNSLRAEDTAVYYCSRWGGDGFYAMDYWGQGTLVTVSSAS

TGGGGSGGGGSGGGGSDIQMTQSPSSLSASVGDRVTITCRASQDVNTAVAWYQQKPGKAP

KLLIYSASFLYSGVPSRFSGSRSGTDFTLTISSLQPEDFATYYCQQHYTTPPTFGQGTKV

EIKRTHHHHHH

SEQ ID NO. 76
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGSGGGGSGGGGSGGGGSEV

-continued

QLVESGGGLVQPGGSLRLSCAASGFNIKDTYIHWVRQAPGKGLEWVARIYPTNGYTRYAD

SVKGRFTISADTSKNTAYLQMNSLRAEDTAVYYCSRWGGDGFYAMDYWGQGTLVTVSSAS

TGGGGSGGGGSGGGGSDIQMTQSPSSLSASVGDRVTITCRASQDVNTAVAWYQQKPGKAP

KLLIYSASFLYSGVPSRFSGSRSGTDFTLTISSLQPEDFATYYCQQHYTTPPTFGQGTKV

EIKRTHHHHHH

SEQ ID NO. 77

MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSGGGGSEV

QLVESGGGLVQPGGSLRLSCAASGFNIKDTYIHWVRQAPGKGLEWVARIYPTNGYTRYAD

SVKGRFTISADTSKNTAYLQMNSLRAEDTAVYYCSRWGGDGFYAMDYWGQGTLVTVSSAS

TGGGGSGGGGSGGGGSDIQMTQSPSSLSASVGDRVTITCRASQDVNTAVAWYQQKPGKAP

KLLIYSASFLYSGVPSRFSGSRSGTDFTLTISSLQPEDFATYYCQQHYTTPPTFGQGTKV

EIKRTHHHHHH

SEQ ID NO. 78

MDFQVQIFSFLLISASVIMSRDIELTQSPTILSASPGEKVTMTCRASSSVNYMDWYQKKP

GSSPKPWIYATSNLASGVPARFSGSGSGTSYSLTISRVEAEDAATYYCQQWSFNPPTFGG

GTKLEIKRGGGGSGGGGSGGGGSMAQVKLQESGAELVKPGASVKMSCKASGYTFTSYNMH

WVKQTPGQGLEWIGAIYPGNGDTSYNQKFKGKATLTADKSSSTAYMQLSSLTSEDSADYY

CARSNYYGSSYWFFDVWGQGTTVTVSSAAAGDPAEPKSPDKTHTCPPCPAPELLGGPSVF

LFPPKPKDTLMISRTPEVTCVVVDVSHEDPEVKFNWYVDGVEVHNAKTKPREEQYNSTYR

VVSVLTVLHQDWLNGKEYKCKVSNKALPAPIEKTISKAKGQPREPQVYTLPPSREEMTKN

QVSLTCLVKGFYPSDIAVEWESNGQPENNYKTTPPVLDSDGSFFLYSKLTVDKSRWQQGN

VFSCSVMHEALHNHYTQKSLSLSPG

SEQ ID NO. 79

MDFQVQIFSFLLISASVIMSRMAQVKLQESGAELVKPGASVYMSCKASGYTFTSYNMHNV

KQTPGQGLEWIGAIYPGNGDTSYNQKFKGKATLTADKSSSTAYMQLSSLTSEDSADYYCA

RSNYYGSSYWFFDVWGQGTTVTVSSGGGGSGGGGSGGGGSDIELTQSPTILSASPGEKVT

MTCRAESSVNYMDWYQKKPGSSPKPWIYATSNLASGVPARFSGSGSGTSYSLTISRVEAE

DAATYYCQQWSFNPPTFGGGTKLEIKRAAAHHHHHH

SEQ ID NO. 80

MDFQVQIFSFLLISASVIMSRDIELTQSPTILSASPGEKVTMTCRASSSVNYMDWYQKKP

GSSPKPWIYATSNLASGVPARFSGSGSGTSYSLTISRVEAEDAATYYCQQWSFNPPTFGG

GTKLEIKRGGGGSGGGGSGGGGSMAQVKLQESGAELVKPGASVKMSCKASGYTFTSYNMH

WVKQTPGQGLEWIGAIYPGNGDTSYNQKFKGKATLTADKSSSTAYMQLSSLTSEDSADYY

CARSNYYGSSYWFFDVWGQGTTVTVSSAAAGDPAEPKSPDKTHTCPPCPAPELLGGPSVF

LFPPKPKDTLMISRTPEVTCVVVDVSHEDPEVKFNWYVDGVEVHNAKTKPREEQYNSTYR

VVSVLTVLHQDWLNGKEYKCKVSNKALPAPIEKTISKAKGQPREPQVYTLPPSREEMTKN

QVSLTCLVKGFYPSDIAVEWESNGQPENNYKTTPPVLDSDGSFFLYSKLTVDKSRWQQGN

VFSCSVMHEALHNHYTQKSLSLSPG

```
                                                    SEQ ID NO. 81
MDFQVQIFSFLLISASVIMSRDIELTQSPTILSASPGEKVTMTCRASSSVNYMDWYQKKP

GSSPKPWIYATSNLASGVPARFSGSGSGTSYSLTISRVEAEDAATYYCQQWSFNPPTFGG

GTKLEIKRGGGGSGGGGSGGGGSMAQVKLQESGAELVKPGASVKMSCKASGYTFTSYNMH

WVKQTPGQGLEWIGAIYPGNGDTSYNQKFKGKATLTADKSSSTAYMQLSSLTSEDSADYY

CARSNYYGSSYWFFDVWGQGTTVTVSSAAAHHHHHH

SEQ ID NO. 82
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSGGGGSMA

QVKLQESGAELVKPGASVKMSCKASGYTFTSYNMHWVKQTPGQGLEWIGAIYPGNGDTSY

NQKFKGKATLTADKSSSTAYMQLSSLTSEDSADYYCARSNYYGSSYWFFDVWGQGTTVTV

SSGGGGSGGGGSGGGGSDIELTQSPTILSASPGEKVTMTCRASSSVNYMDWYQKKPGSSP

KPWIYATSNLASGVPARFSGSGSGTSYSLTISRVEAEDAATYYCQQWSFNPPTFGGGTKL

EIKRAAAGDPAEPKSPDKTHTCPPCPAPELLGGPSVFLFPPKPKDTLMISRTPEVTCVVV

DVSHEDPEVKFNWYVDGVEVHNAKTKPREEQYNSTYRVVSVLTVLHQDWLNGKEYKCKVS

NKALPAPIEKTISKAKGQPREPQVYTLPPSREEMTKNQVSLTCLVKGFYPSDIAVEWESN

GQPENNYKTTPPVLDSDGSFFLYSKLTVDKSRWQQGNVFSCSVMHEALHNHYTQKSLSLS

PG

SEQ ID NO. 83
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSGGGGSMA

QVKLQESGAELVKPGASVKMSCKASGYTFTSYNMHWVKQTPGQGLEWIGAIYPGNGDTSY

NQKFKGKATLTADKSSSTAYMQLSSLTSEDSADYYCARSNYYGSSYWFFDVWGQGTTVTV

SSGGGGSGGGGSGGGGSDIELTQSPTILSASPGEKVTMTCRASSSVNYMDWYQKKPGSSP

KPWIYATSNLASGVPARFSGSGSGTSYSLTISRVEAEDAATYYCQQWSFNPPTFGGGTKL

EIKRAAAHHHHHH

SEQ ID NO. 84
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSGGGGSDI

ELTQSPTILSASPGEKVTMTCRASSSVNYMDWYQKKPGSSPKPWIYATSNLASGVPARFS

GSGSGTSYSLTISRVEAEDAATYYCQQWSFNPPTFGGGTKLEIKRGGGGSGGGGSGGGGS

MAQVKLQESGAELVKPGASVKMSCKASGYTFTSYNMHWVKQTPGQGLEWIGAIYPGNGDT

SYNQKFKGKATLTADKSSSTAYMQLSSLTSEDSADYYCARSNYYGSSYWFFDVWGQGTTV

TVSSAAAGDPAEPKSPDKTHTCPPCPAPELLGGPSVFLFPPKPKDTLMISRTPEVTCVVV
```

DVSHEDPEVKFNWYVDGVEVHNAKTKPREEQYNSTYRVVSVLTVLHQDWLNGKEYKCKVS

NKALPAPIEKTISKAKGQPREPQVYTLPPSREEMTKNQVSLTCLVKGFYPSDIAVEWESN

GQPENNYKTTPPVLDSDGSFFLYSKLTVDKSRWQQGNVFSCSVMHEALHNHYTQKSLSLS

PG

SEQ ID NO. 85

MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSGGGGSDI

ELTQSPTILSASPGEKVTMTCRASSSVNYMDWYQKKPGSSPKPWIYATSNLASGVPARFS

GSGSGTSYSLTISRVEAEDAATYYCQQWSFNPPTFGGGTKLEIKRGGGGSGGGGSGGGGS

MAQVKLQESGAELVKPGASVKMSCKASGYTFTSYNMHWVKQTPGQGLEWIGAIYPGNGDT

SYNQKFKGKATLTADKSSSTAYMQLSSLTSEDSADYYCARSNYYGSSYWFFDVWGQGTTV

TVSSAAAHHHHHH

SEQ ID NO. 86

MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSGGGGSQV

QLVQSGAEDVKPDASVKLSCKASGYTFTDYYMHWVRQAPGQGLKWMGWINTYTGESTYAD

DFKGRFAFSLDTSASTAYLQLSSLRGEDTAVYFCARFAIKGDYWGQGTTVTVSSASTGGG

GSGGGGSGGGGSGGGGSDIVMTQSPLSLEVSPGEPASISCRSTKSLLHSDGITYLYWYLQ

KPGQSPQLLIYQLSNLASGVPDRFSSSGSGTDFTLKISRVEAEDEGTYYCAQNLEIPRTF

GQGTKLEIKRTHHHHHH

SEQ ID NO. 87

MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSGGGGSQV

QLVQSGAEDVKPDASVKLSCKASGYTFTDYYMHWVRQAPGQGLEWMGRVNPNRRGTTYNQ

KFEGRVTMTTDTSTSTAYMQLSSLRGEDTAVYYCARANWLDYWGQGTTVTVSSASTGGGG

SGGGGSGGGGSGGGGSDIQMTQSPSSLEASVGDRVTITCSVSSSVSSIYLHWYQQKPGKS

PKLLIYSTSNLASGVPDRFSGSGSGTDFTLTISSLQAEDEGTYYCQVYSGYPLTFGGGTK

LEIKRTHHHHHH

SEQ ID NO. 88

MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

-continued

VMETGLLLPRATAQDAGKYYCHRGNLTMSFHLEITARPGGGGSGGGGSGGGGSGGGGSQV

QLQESGPGDVKPSETLSLTCTVSGGSVSSGDYYWTWIRQSPGKGLEWIGHIYYSGNTNYN

PSLKSRLTISIDTSKTTFSLQLSSVTGEDTAIYYCVRDRVTGAFDIWGQGTTVTVSSAST

GGGGSGGGGSGGGGSGGGGSDIQMTQSPSSLEASVGDRVTITCQASQDISNYLNWYQQKP

GKSPKLLIYDASNLETGVPDRFSGSGSGTDFTFTISSLQAEDEGTYFCQHFDHLPLAFGG

GTKLEIKRTHHHHHH

SEQ ID NO. 89
METDTLLLWVLLLWVPGSTGDIVLTQSPPSLAMSLGKRATISCRASESVTILGSHLIHWY

QQKPGQPPTLLIQLASNVQTGVPARFSGSGSRTDFTLTIDPVEEDDVAVYYCLQSRTIPR

TFGGGTKLEIKGSTSGSGKPGSGEGSTKGQIQLVQSGPELKKPGETVKISCKASGYTFTD

YSINWVKRAPGKGLKWMGWINTETREPAYAYDFRGRFAFSLETSASTAYLQINNLKYEDT

ATYFCALDYSYAMDYWGQGTSVTVSSGGGGSGGGGSGGGGSHHHHHH

SEQ ID NO. 90
MEFGLSWVFLVALFRGVQCQIQLVQSGPELKKPGETVKISCKASGYTFTDYSINWVKRAP

GKGLKWMGWINTETREPAYAYDFRGRFAFSLETSASTAYLQINNLKYEDTATYFCALDYS

YAMDYWGQGTSVTVSSGSTSGSGKPGSGEGSTKGDIVLTQSPPSLAMSLGKRATISCRAS

ESVTILGSHLIHWYQQKPGQPPTLLIQLASNVQTGVPARFSGSGSRTDFTLTIDPVEEDD

VAVYYCLQSRTIPRTFGGGTKLEIKGGGGSGGSGSGGGGSHHHHHH

SEQ ID NO. 91
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSGGGGSDI

VLTQSPPSLAMSLGKRATISCRASESVTILGSHLIHWYQQKPGQPPTLLIQLASNVQTGV

PARFSGSGSRTDFTLTIDPVEEDDVAVYYCLQSRTIPRTFGGGTKLEIKGSTSGSGKPGS

GEGSTKGQIQLVQSGPELKKPGETVKISCKASGYTFTDYSINWVKRAPGKGLKWMGWINT

ETREPAYAYDFRGRFAFSLETSASTAYLQINNLKYEDTATYFCALDYSYAMDYWGQGTSV

TVSSGGGGSGGGGSGGSGSHHHHHH

SEQ ID NO. 92
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSGGGGSQI

QLVQSGPELKKPGETVKISCKASGYTFTDYSINWVKRAPGKGLKWMGWINTETREPAYAY

DFRGRFAFSLETSASTAYLQINNLKYEDTATYFCALDYSYAMDYWGQGTSVTVSSGSTSG

SGKPGSGEGSTKGDIVLTQSPPSLAMSLGKRATISCRASESVTILGSHLIHWYQQKPGQP

PTLLIQLASNVQTGVPARFSGSGSRTDFTLTIDPVEEDDVAVYYCLQSRTIPRTFGGGTK

LEIKGGGGSGGGGSGGGGSHHHHHH

SEQ ID NO. 93
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

-continued

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPDKTHTCPPCPAPELLGGPSVFL

FPPKPKDTLMISRTPEVTCVVVDVSHEDPEVKFNWYVDGVEVHNAKTKPREEQYNSTYRV

VSVLTVLHQDWLNGKEYKCKVSNKALPAPIEKTISKAKGQPREPQVYTLPPSREEMTKNQ

VSLTCLVKGYYPSDIAVEWESNGQPENNYKTTPPVLDSDGSFFLYSKLTVDKSRWQQGNV

FSCSVMHEALHNHYTQKSLSLSPGGGGSGGGGSGGGGSGGGGSEVQLVESGGGLVQPGG

SLRLSCAASGFNIKDTYIHWVRQAPGKGLEWVARIYPTNGYTRYADSVKGRFTISADTSK

NTAYLQMNSLRAEDTAVYYCSRWGGDGFYAMDYWGQGTLVTVSSASTGGGGSGGGGSGGG

GSDIQMTQSPSSLSASVGDRVTITCRASQDVNTAVAWYQQKPGKAPKLLIYSASFLYSGV

PSRFSGSRSGTDFTLTISSLQPEDFATYYCQQHYTTPPTFGQGTKVEIKRT

SEQ ID NO. 94
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSGGGGSEV

QLVESGGGLVQPGGSLRLSCAASGFNIKDTYIHWVRQAPGKGLEWVARIYPTNGYTRYAD

SVKGRFTISADTSKNTAYLQMNSLRAEDTAVYYCSRWGGDGFYAMDYWGQGTLVTVSSAS

TGGGGSGGGGSGGGGSDIQMTQSPSSLSASVGDRVTITCRASQDVNTAVAWYQQKPGKAP

KLLIYSASFLYSGVPSRFSGSRSGTDFTLTISSLQPEDFATYYCQQHYTTPPTFGQGTKV

EIKRTGGGGSGGGGSGGGGSGGGGSQVQLQESGPGDVKPSETLSLTCTVSGGSVSSGDYY

WTWIRQSPGKGLEWIGHIYYSGNTNYNPSLKSRLTISIDTSKTTFSLQLSSVTGEDTAIY

YCVRDRVTGAFDIWGQGTTVTVSSASTGGGGSGGGGSGGGGSGGGGSDIQMTQSPSSLEA

SVGDRVTITCQASQDISNYLNWYQQKPGKSPKLLIYDASNLETGVPDRFSGSGSGTDFTF

TISSLQAEDEGTYFCQHFDDHLPLAFGGGTKLEIKRTGGGGSHHHHHH

SEQ ID NO. 95
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSGGGGSEV

QLVESGGGLVQPGGSLRLSCAASGFNIKDTYIHWVRQAPGKGLEWVARIYPTNGYTRYAD

SVKGRFTISADTSKNTAYLQMNSLRAEDTAVYYCSRWGGDGFYAMDYWGQGTLVTVSSAS

TGGGGSGGGGSGGGGSDIQMTQSPSSLSASVGDRVTITCRASQDVNTAVAWYQQKPGKAP

KLLIYSASFLYSGVPSRFSGSRSGTDFTLTISSLQPEDFATYYCQQHYTTPPTFGQGTKV

EIKRTGGGGSGGGGSGGGGSGGGGSDIQMTQSPSSLEASVGDRVTITCQASQDISNYLNW

YQQKPGKSPKLLIYDASNLETGVPDRFSGSGSGTDFTFTISSLQAEDEGTYFCQHFDHLP

LAFGGGTKLEIKRTGGGGSGGGGSGGGGSGGGGSQVQLQESGPGDVKPSETLSLTCTVSG

GSVSSGDYYWTWIRQSPGKGLEWIGHIYYSGNTNYNPSLKSRLTISIDTSKTTFSLQLSS

VTGEDTAIYYCVRDRVTGAFDIWGTTVTVSSASTGGGGSHHHHHH

-continued

SEQ ID NO. 96

MEFGLSWVFLVALFRGVQCEVQLVESGGGLVQPGGSLRLSCAASGFNIKDTYIHWVRQAP
GKGLEWVARIYPTNGYTRYADSVKGRFTISADTSKNTAYLQMNSLRAEDTAVYYCSRWGG
DGFYAMDYWGQGTLVTVSSASTGGGGSGGGGSGGGGSDIQMTQSPSSLSASVGDRVTITC
RASQDVNTAVAWYQQKPGKAPKLLIYSASFLYSGVPSRFSGSRSGTDFTLTISSLQPEDF
ATYYCQQHYTTPPTFGQGTKVEIKRTGGGGSGGGGSGGGGSGGGGSQVQLQESGPGDVKP
SETLSLTCTVSGGSVSSGDYYWTWIRQSPGKGLEWIGHIYYSGNTNYNPSLKSRLTISID
TSKTTFSLQLSSVTGEDTAIYYCVRDRVTGAFDIWGQGTTVTVSSASTGGGGSGGGGSGG
GGSGGGGSDIQMTQSPSSLEASVGDRVTITCQASQDISNYLNWYQQKPGKSPKLLIYDAS
NLETGVPDRFSGSGSGTDFTFTISSLQAEDEGTYFCGHFDHLPLAFGGGTKLEIKRTGGG
GSHHHHHH

SEQ ID NO. 97

MEFGLSWVFLVALFRGVQCEVQLVESGGGLVQPGGSLRLSCAASGFNIKDTYIHWVRQAP
GKGLEWVARIYPTNGYTRYADSVKGRFTISADTSKNTAYLQMNSLRAEDTAVYYCSRWGG
DGFYAMDYWGQGTLVTVSSASTGGGGSGGGGSGGGGSDIQMTQSPSSLSASVGDRVTITC
RASQDVNTAVAWYQQKPGKAPKLLIYSASFLYSGVPSRFSGSRSGTDFTLTISSLQPEDF
ATYYCQQHYTTPPTFGQGTKVEIKRTGGGGSGGGGSGGGGSGGGGSDIQMTQSPSSLEAS
VGDRVTITCQASQDISNYLNWYQQKPGKSPKLLIYDASNLETGVPDRFSGSGSGTDFTFT
ISSLQAEDEGTYFCQHFDHLPLAFGGGTKLEIKRTGGGGSGGGGSGGGGSGGGGSQVQLQ
ESGPGDVKPSETLSLTCTVSGGSVSSGDYYWTWIRQSPGKGLEWIGHIYYSGNTNYNPSL
KSRLTISIDTSKTTFSLQLSSVTGEDTAIYYCVRDRVTGAFDIWGQGTTVTVSSASTGGG
GSHHHHHH

SEQ ID NO. 98

MPPPRLLFFLLFLTPMEVRPEEPLVVKVEEGDNAVLQCLKGTSDGPTQQLTWSRESPLKP
FLKLSLGLPGLGIHMRPLAIWLFIFNVSQQMGGFYLCQPGPPSEKAWQPGWTVNVEGSGE
LFRWNVSDLGGLGCGLKNRSSEGPSSPSGKLMSPKLYVWAKDRPEIWEGEPPCLPPRDSL
NQSLSQDLTMAPGSTLWLSCGVPPDSVSRGPLSWTHVHPKGPKSLLSLELKDDRPARDMW
VMETGLLLPRATAQDAGKYYCHRGNLTMSFHLEITARPGGGGSGGGGSGGGGSGGGGSEV
QLVESGGGLVQPGGSLRLSCAASGFNIKDTYIHWVRQAPGKGLEWVARIYPTNGYTRYAD
SVKGRFTISADTSKNTAYLQMNSLRAEDTAVYYCSRWGGDGFYAMDYWGQGTLVTVSSAS
TGGGGSGGGGSGGGGSDIQMTQSPSSLSASVGDRVTITCRASQDVNTAVAWYQQKPGKAP
KLLIYSASFLYSGVPSRFSGSRSGTDFTLTISSLQPEDFATYYCQQHYTTPPTFGQGTKV
EIKRTHHHHHH

SEQ ID NO. 99

MDFQVQIFSFLLISASVIMSRMAQVKLQESGAELVKPGASVKMSCKASGYTFTSYNMHWV
KQTPGQGLEWIGAIYPGNGDTSYNQKFKGKATLTADKSSSTAYMQLSSLTSEDSADYYCA
RSNYYGSSYWFFDVWGQGTTVTVSSGGGGSGGGGSGGGGSDIELTQSPTILSASPGEKVT
MTCRASSSVNYMDWYQKKPGSSPKPWIYATSNLASGVPARFSGSGEGTSYSLTISRVEAE
DAATYYCQQWSFNPPTFGGGTKLEIKRAAAGDPAEPKSPDKTHTCPPCPAPELLGGPSVF
LFPPKPKDTLMISRTPEVTCVVVDVSHEDPEVKFNWYVDGVEVHNAKTKPREEQYNSTYR
VVSVLTVLHQDWLNGKEYKCKVSNKALPAPIEKTISKAKGQPREPQVYTLPPSREEMTKN

-continued

QVSLTCLVKGFYPSDIAVEWESNGQPENNYKTTPPVLDSDSSFFLYSKLTVDKSRWQQGN

VFSCSVMHEALHNHYTQKSLSLSPG

SEQ ID NO. 100

MDFQVQIFSFLLISASVIMSRMAQVKLQESGAELVKPGASVKMSCKASGYTFTSYNMHWV

KQTPGQGLEWIGAIYPGNGDTSYNQKFKGKATLTADKSSTAYMQLSSLTSEDSADYYCA

RSNYYGSSYWFFDVWGQGTTVTVSSGGGGSGGGGSGGGGSDIELTQSPTILSASPGEKVT

MTCRASSSVNYMDWYQKKPGSSPKPWIYATSNLASGVPARFSGSGEGTSYSLTISRVEAE

DAATYYCQQWSFNPPTFGGGTKLEIKRAAAHHHHHH

SEQ ID NO. 101

MDFQVQIFSFLLISASVIMSRDIELTQSPTILSASPGEKVTMTCRASSSVNYMDWYQKKP

GSSPKPWIYATSNLASGVPARFSGSGSGTSYSLTISRVEAEDAATYYCQQWSFNPPTFGG

GTKLEIKRGGGGSGGGGSGGGGSMAQVKLQESGAELVKPGASVKMSCKASGYTFTSYNMH

WVKQTPGQGLEWIGAIYPGNGDTSYNQKFKGKATLTADKSSTAYMQLSSLTSEDSADYY

CARSNYYGSSYWFFDVWGQGTTVTVSSAAAGDPAEPKSPDKTHTCPPCPAPELLGGPSVF

LFPPKPKDTLMISRTPEVTCVVVDVSHEDPEVKFNWYVDGVEVHNAKTKPREEQYNSTYR

VVSVLTVLHQDWLNGKEYKCKVSNKALPAPIEKTISKAKGQPREPQVYTLPPSREEMTKN

QVSLTCLVKGFYPSDIAVEWESNGQPENNYKTTPPVLDSDSSFFLYSKLTVDKSRWQQGN

VFSCSVMHEALHNHYTQKSLSLSPG

SEQ ID NO. 102

MDFQVQIFSFLLISASVIMSRDIELTQSPTILSASPGEKVTMTCRASSSVNYMDWYQKKP

GSSPKPWIYATSNLASGVPARFSGSGSGTSYSLTISRVEAEDAATYYCQQWSFNPPTFGG

GTKLEIKRGGGGSGGGGSGGGGSMAQVKLQESGAELVKPGASVKMSCKASGYTFTSYNMH

WVKQTPGQGLEWIGAIYPGNGDTSYNQKFKGKATLTADKSSTAYMQLSSLTSEDSADYY

CARSNYYGSSYWFFDVWGQGTTVTVSSAAAHHHHHH

SEQ ID NO. 103

MEFGLSWVFLVALFRGVQCEVQLVESGGGLVQPGGSLRLSCAASGFNIKDTYIHWVRQAP

GKGLEWVARIYPTNGYTRYADSVKGRFTISADTSKNTAYLQMNSLRAEDTAVYYCSRWGG

DGFYAMDYWGQGTLVTVSSASTGGGGSGGGGSGGGGSDIQMTQSPSSLSASVGDRVTITC

RASQDVNTAVAWYQQKPGKAPKLLIYSASFLYSGVPSRFSGSRSGTDFTLTISSLQPEDF

ATYYCQQHYTTPPTFGQGTKVEIKRTDKTHTCPPCPAPELLGGPSVFLFPPKPKDTLMIS

RTPEVTCVVVDVSHEDPEVKFNWYVDGVEVHNAKTKPREEQYNSTYRVVSVLTVLHQDWL

NGKEYKCKVSNKALPAPIEKTISKAKGQPREPQVYTLPPSREEMTKNQVSLTCLVKGFYP

SDIAVEWESNGQPENNYKTTPPVLDSDGSFFLYSKLTVDKSRWQQGNVFSCSVMHEALHN

HYTQKSLSLSPG

SEQ ID NO. 104

MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSGGGGSGG

GGSGGGGSGGGGSMAQVKLQESGAELVKPGASVKMSCKASGYTFTSYNMHWVMQTPGQGL

EWIGAIYPGNGDTSYNQKFKGKATLTADKSSTAYMQLSSLTSEDSADYYCARSNYYGSS

YWFFDVWGQGTTVTVSSGGGGSGGGGSGGGGSDIELTQSPTILSASPGEKVTMTCRASSS

```
VNYMDWYQKKPGSSPKPWIYATSNLASGVPARFSGSGSGTSYSLTISRVEAEDAATYYCQ

QWSFNPPTFGGGTKLEIKRAAAGDPAEPKSPDKTHTCPPCPAPELLGGPSVFLFPPKPKD

TLMISRTPEVTCVVVDVSHEDPEVKFNWYVDGVEVHNAKTKPREEQYNSTYRVVSVLTVL

HQDWLNGKEYKCKVSNKALPAPIEKTISKAKGQPREPQVYTLPPSREEMTKNQVSLTCLV

KGFYPSDIAVEWESNGQPENNYKTTPPVLDSDGSFFLYSKLTVDKSRWQQGNVFSCSVMH

EALHNHYTQKSLSLSPG
```

SEQ ID NO. 105
```
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSGGGGSGG

GGSGGGGSGGGGSMAQVKLQESGAELVKPGASVYMSCKASGYTFTSYNMHNVKQTPGQGL

EWIGAIYPGNGDTSYNQKFKGKATLTADKSSSTAYMQLSSLTSEDSADYYCARSNYYGSS

YWFFDVWGQGTTVTVSSGGGGSGGGGSGGGGSDIELTQSPTILSASPGEKVTMTCRASSS

VNYMDWYQKKPGSSPKPWIYATSNLASGVPARFSGSGSGTSYSLTISRVEAEDAATYYCQ

QWSFNPPTFGGGTKLEIKRAAAHHHHHH
```

SEQ ID NO. 106
```
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPDPAEPKSPDKTHTCPPCPAPEL

LGGPSVFLFPPKPKDTLMISRTPEVTCVVVDVSHEDPEVKFNWYVDGVEVHNAKTKPREE

QYNSTYRVVSVLTVLHQDWLNGKEYKCKVSNKALPAPIEKTISKAKGQPREPQVYTLPPS

REEMTKNQVSLTCLVKGFYPSDIAVEWESNGQPENNYKTTPPVLDSDGSFFLYSKLTVDK

SRWQQGNVFSCSVMHEALHNHYTQKSLSLSPGGGGGSGGGGSGGGGSGGGGSMAQVKLQE

SGAELVKPGASVKMSCKASGYTFTSYNMHWVKQTPGQGLEWIGAIYPGNGDTSYNQKFKG

KATLTADKSSSTAYMQLSSLTSEDSADYYCARSNYYGSSYWFFDVWGQGTTVTVSSGGGG

SGGGGSGGGGSDIELTQSPTILSASPGEKVTMTCRASSSVNYMDWYQKKPGSSPKPWIYA

TSNLASGVPARFSGSGSGTSYSLTISRVEAEDAATYYCQQWSFNPPTFGGGTKLEIKRA
```

SEQ ID NO. 107
```
MDFQVQIFSFLLISASVIMSRMAQVKLQESGAELVKPGASVKMSCKASGYTFTSYNMHWV

KQTPGQGLEWIGAIYPGNGDTSYNQKFKGKATLTADKSSSTAYMQLSSLTSEDSADYYCA

RSNYYGSSYWFFDVWGQGTTVTVSSGGGGSGGGGSGGGGSDIELTQSPTILSASPGEKVT

MTCRASSSVNYMDWYQKKPGSSPKPWIYATSNLASGVPARFSGSGSGTSYSLTISRVEAE

DAATYYCQQWSFNPPTFGGGTKLEIKRAAAGGGGSGGGGSGGGGSGGGGSPEEPLVVKVE

EGDNAVLQCLKGTSDGPTQQLTWSRESPLKPFLKLSLGLPGLGIHMRPLAIWLFIFNVSQ

QMGGFYLCQPGPPSEKAWQPGWTVNVEGSGELFRWNVSDLGGLGCGLKNRSSEGPSSPSG

KLMSPKLYVWAKDRPEIWEGEPPCLPPRDSLNQSLSQDLTMAPGSTLWLSCGVPPDSVSR

GPLSWTHVHPKGPKSLLSLELKDDRPARDMWVMETGLLLPRATAQDAGKYYCHRGNLTMS

FHLEITARPDPAEPKSPDKTHTCPPCPAPELLGGPSVFLFPPKPKDTLMISRTPEVTCVV
```

-continued

VDVSHEDPEVKFNWYVDGVEVENAKTKPREEQYNSTYRVVSVLTVLHQDWLNGYEYKCKV

SNKALPAPIEKTISKAKGQPREPQVYTLPPSREEMTKNQVSLTCLVKGFYPSDIAVEWES

NGQPENNYKTTPPVLDSDGSFFLYSKLTVDKSRWQQGNVFSCSVMHEALHNHYTQKSLSL

SPG

SEQ ID NO. 108

MLRLLLALNLFPSIQVTGDIQMTQTTSSLSASLGDRVTISCRASQDISKYLNWYQQKPDG

TVKLLIYHTSRLHSGVPSRFSGSGSGTDYSLTISNLEQEDIATYFCQQGNTLPYTFGGGT

KLEITGGGGSGGGGSGGGGSGGGGSEVKLQESGPGLVAPSQSLSVTCTVSGVSLPDYGVS

WIRQPPRKGLEWLGVIWGSETTYYNSALKSRLTIIKDNSKSQVFLKMNSLQTDDTAIYYC

AKHYYYGGSYAMDYWGQGTSVTVSSDYKDDDDKIEVMYPPPYLDNEKSNGTIIHVKGKHL

CPSPLFPGPSKPFWVLVVVGGVLACYSLLVTVAFIIFWVRSKRSRLLHSDYMNMTPRRPG

PTRKHYQPYAPPRDFAAYRSKRGRKKLLYIFKQPFMRPVQTTQEEDGCSCRFPEEEEGGC

ELRVKFSRSADAPAYQQGQNQLYNELNLGRREEYDVLDKRKGRDPEMGGKPQRRKNPQEG

LYNELQKDKMAEAYSEIGMKGERRRGKGHDGLYQGLSTATKDTYDALHMQALPPREGRGS

LLTCGDVEENPGPMPPPRLLFFLLFLTPMEVRPEEPLVVKVEEGDNAVLQCLKGTSDGPT

QQLTWSRESPLKPFLKLSLGLPGLGIHMRPLAIWLFIFNVSQQMGGFYLCQPGPPSEKAW

QPGWTVNVEGSGELFRWNVSDLGGLGCGLKNRSSEGPSSPSGKLMSPKLYVWAKDRPEIW

EGEPPCLPPRDSLNQSLSQDLTMAPGSTLWLSCGVPPDSVSRGPLSWTHVHPKGPKSLLS

LELKDDRPARDMWVMETGLLLPRATAQDAGKYYCHRGNLTMSFHLEITARPGGGGSGGGG

SGGGGSGGGGSEVQLVESGGGLVQPGGSLRLSCAASGFNIKDTYIHWVRQAPGKGLEWVA

RIYPTNGYTRYADSVKGRFTISADTSKNTAYLQMNSLRAEDTAVYYCSRWGGDGFYAMDY

WGQGTLVTVSSASTGGGGSGGGGSGGGGSDIQMTQSPSSLSASVGDRVTITCRASQDVNT

AVAWYQQKPGKAPKLLIYSASFLYSGVPSRFSGSRSGTDFTLTISSLQPEDFATYYCQQH

YTTPPTFGQGTKVEIKRTSRHHHHHH

SEQ ID NO. 109

MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSGGGGSEV

QLVESGGGLVQPGGSLRLSCAASGFNIKDTYIHWVRQAPGKGLEWVARIYPTNGYTRYAD

SVKGRFTISADTSKNTAYLQMNSLRAEDTAVYYCSRWGGDGFYAMDYWGQGTLVTVSSAS

TGGGGSGGGGSGGGGSDIQMTQSPSSLSASVGDRVTITCRASQDVNTAVAWYQQKPGKAP

KLLIYSASFLYSGVPSRFSGSRSGTDFTLTISSLQPEDFATYYCQQHYTTPPTFGQGTKV

EIKRTSRHHHHHHEGRGSLLTCGDVEENPGPMLRLLLALNLFPSIQVTGDIQMTQTTSSL

SASLGDRVTISCRASQDISKYLNWYQQKPDGTVKLLIYHTSRLHSGVPSRFSGSGSGTDY

SLTISNLEQEDIATYFCQQGNTLPYTFGGGTKLEITGGGGSGGGGSGGGGSGGGGSEVKL

QESGPGLVAPSQSLSVTCTVSGVSLPDYGVSWIRQPPRKGLEWLGVIWGSETTYYNSALK

SRLTIIKDNSKSQVFLKMNSLQTDDTAIYYCAKHYYYGGSYAMDYWGQGTSVTVSSDYKD

DDDKIEVMYPPPYLDNEKSNGTIIHVKGKHLCPSPLFPGPSKPFWVLVVVGGVLACYSLL

VTVAFIIFWVRSKRSRLLHSDYMNMTPRRPGPTRKHYQPYAPPRDFAAYRSKRGRKKLLY

```
                                                              -continued
IFKQPFMRPVQTTQEEDGCSCRFPEEEEGGCELRVKFSRSADAPAYQQGQNQLYNELNLG

RREEYDVLDKRKGRDPEMGGKPQRRKNPQEGLYNELQKDKMAEAYSEIGMKGERRRGKGH

DGLYQGLSTATKDTYDALHMQALPPR
                                                                SEQ ID NO. 110
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSGGGGSEV

QLVESGGGLVQPGGSLRLSCAASGFNIKDTYIHWVRQAPGKGLEWVARIYPTNGYTRYAD

SVKGRFTISADTSKNTAYLQMNSLRAEDTAVYYCSRWGGDGFYAMDYWGQGTLVTVSSAS

TGGGGSGGGGSGGGGSDIQMTQSPSSLSASVGDRVTITCRASQDVNTAVAWYQQKPGKAP

KLLIYSASFLYSGVPSRFSGSRSGTDFTLTISSLQPEDFATYYCQQHYTTPPTFGQGTKV

EIKRTHHHHHH
                                                                SEQ ID NO. 111
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPGGGGSGGGGSGGGGSGGGGSEV

QLVESGGGLVQPGGSLRLSCAASGFNIKDTYIHWVRQAPGKGLEWVARIYPTNGYTRYAD

SVKGRFTISADTSKNTAYLQMNSLRAEDTAVYYCSRWGGDGFYAMDYWGQGTLVTVSSAS

TGGGGSGGGGSGGGGSDIQMTQSPSSLSASVGDRVTITCRASQDVNTAVAWYQQKPGKAP

KLLIYSASFLYSGVPSRFSGSRSGTDFTLTISSLQPEDFATYYCQQHYTTPPTFGQGTKV

EIKRTHHHHHH
                                                                SEQ ID NO. 112
MPPPRLLFFLLFLTPMEVRPEEPLVVKVEEGDNAVLQCLKGTSDGPTQQLTWSRESPLKP

FLKLSLGLPGLGIHMRPLAIWLFIFNVSQQMGGFYLCQPGPPSEKAWQPGWTVNVEGSGE

LFRWNVSDLGGLGCGLKNRSSEGPSSPSGKLMSPKLYVWAKDRPEIWEGEPPCLPPRDSL

NQSLSQDLTMAPGSTLWLSCGVPPDSVSRGPLSWTHVHPKGPKSLLSLELKDDRPARDMW

VMETGLLLPRATAQDAGKYYCHRGNLTMSFHLEITARPVLWHWLLRTGGWK
```

Listing of Nucleotide Sequences

```
                                                                SEQ ID NO. 201
ATGGAGTTTGGGCTGAGCTGGGTTTTCCTCGTTGCTCTTTTTAGAGGTGTCCAGTGTCAGGTGCAGCTGCAGGAGTCG

GGCCCAGGACTGGTGAAGCCTTCGGAGACCCTGTCCCTCACCTGCACTGTCTCTGGTGGCTCCGTCAGCAGTGGTGAT

TACTACTGGACCTGGATCCGGCAGTCCCCAGGGAAGGGACTGGAGTGGATTGGACACATCTATTACAGTGGGAACACC

AATTATAACCCCTCCCTCAAGAGTCGACTCACCATATCAATTGACACGTCCAAGACTCAGTTCTCCCTGAAGCTGAGT

TCTGTGACCGCTGCGGACACGGCCATTTATTACTGTGTGCGAGATCGAGTGACTGGTGCTTTTGATATCTGGGGCCAA

GGGACAATGGTCACCGTCTCTTCAGCCTCCACCAAGGGCCCATCGGTCTTCCCCCTGGCGCCCTGCTCCAGGAGCACC

TCCGAGAGCACAGCGGCCCTGGGCTGCCTGGTCAAGGACTACTTCCCTGAACCGGTGACGGTGTCGTGGAACTCAGGC

GCTCTGACCAGCGGCGTGCACACCTTCCCGGCTGTCCTACAGTCCTCAGGACTCTACTCCCTCAGCAGCGTGGTGACC

GTGCCCTCCAGCAACTTCGGCACCCAGACCTACACCTGCAACGTAGATCACAAGCCCAGCAATACCAAGGTGGACAAG
```

-continued

ACAGTTGAGCGCAAATGTTGTGTCGAGTGCCCACCGTGCCCAGCACCACCTGTGGCAGGACCGTCAGTCTTCCTCTTC

CCCCCAAAACCCAAGGACACCCTCATGATCTCCCGGACCCCTGAGGTCACGTGCGTGGTGGTGGACGTGAGCCACGAA

GACCCCGAGGTCCAGTTCAACTGGTACGTGGACGGCGTGGAGGTGCATAATGCCAAGACAAAGCCACGGGAGGAGCAG

TTCCAAAGCACGTTCCGTGTGGTCAGCGTCCTCACCGTCGTGCACCAGGACTGGCTGAACGGCAAGGAGTACAAGTGC

AAGGTCTCCAACAAAGGCCTCCCAGCCCCCATCGAGAAAACCATCTCCAAAACCAAAGGGCAGCCCCGAGAACCACAG

GTGTACACCCTGCCCCCATCCCGGGAGGAGATGACCAAGAACCAGGTCAGCCTGACCTGCCTGGTCAAAGGCTTCTAC

CCCAGCGACATCGCCGTGGAGTGGGAGAGCAATGGGCAGCCGGAGAACAACTACAAGACCACGCCTCCCATGCTGGAC

TCCGACGGCTCCTTCTTCCTCTACAGCAAGCTCACCGTGGACAAGAGCAGGTGGCAGCAGGGGAACGTCTTCTCATGC

TCCGTGATGCATGAGGCTCTGCACAACCACTACACGCAGAAGAGCCTCTCCCTGTCTCCGGGT

SEQ ID NO. 202

ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

GCCATCTGGCTTTTCATCTTCAACGTCTCTCAACAGATGGGGGGCTTCTACCTGTGCCAGCCGGGGCCCCCCTCTGAG

AAGGCCTGGCAGCCTGGCTGGACAGTCAATGTGGAGGGCAGCGGGGAGGTGGGTCTGGAGGTGGAGGATCTGGTGGA

GGTGGGTCTGACATCCAGATGACCCAGTCTCCATCCTCCCTGTCTGCATCTGTAGGAGACAGAGTCACCATCACTTGC

CAGGCGAGTCAGGACATCAGCAACTATTTAAATTGGTATCAGCAGAAACCAGGGAAAGCCCCTAAACTCCTGATCTAC

GATGCATCCAATTTGGAAACAGGGGTCCCATCAAGGTTCAGTGGAAGTGGATCTGGGACAGATTTTACTTTCACCATC

AGCAGCCTGCAGCCTGAAGATATTGCAACATATTTCTGTCAACACTTTGATCATCTCCCGCTCGCTTTCGGCGGAGGG

ACCAAGGTGGAGATCAAACGAACTGTGGCTGCACCATCTGTCTTCATCTTCCCGCCATCTGATGAGCAGTTGAAATCT

GGAACTGCCTCTGTTGTGTGCCTGCTGAATAACTTCTATCCCAGAGAGGCCAAAGTACAGTGGAAGGTGGATAACGCC

CTCCAATCGGGTAACTCCCAGGAGAGTGTCACAGAGCAGGACAGCAAGGACAGCACCTACAGCCTCAGCAGCACCCTG

ACGCTGAGCAAAGCAGACTACGAGAAACACAAAGTCTACGCCTGCGAAGTCACCCATCAGGGCCTGAGCTCGCCCGTC

ACAAAGAGCTTCAACAGGGGAGAGTGT

SEQ ID NO. 203

ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

GCCATCTGGCTTTTCATCTTCAACGTCTCTCAACAGATGGGGGGCTTCTACCTGTGCCAGCCGGGGCCCCCCTCTGAG

AAGGCCTGGCAGCCTGGCTGGACAGTCAATGTGGAGGGCAGCGGGGAGGTGGGTCTGGAGGTGGAGGATCTGGTGGA

GGTGGGTCTCAGGTGCAGCTGCAGGAGTCGGGCCCAGGACTGGTGAAGCCTTCGGAGACCCTGTCCCTCACCTGCACT

GTCTCTGGTGGCTCCGTCAGCAGTGGTGATTACTACTGGACCTGGATCCGGCAGTCCCCAGGGAAGGGACTGGAGTGG

ATTGGACACATCTATTACAGTGGGAACACCAATTATAACCCCTCCCTCAAGAGTCGACTCACCATATCAATTGACACG

TCCAAGACTCAGTTCTCCCTGAAGCTGAGTTCTGTGACCGCTGCGGACACGGCCATTTATTACTGTGTGCGAGATCGA

GTGACTGGTGCTTTTGATATCTGGGGCCAAGGGACAATGGTCACCGTCTCTTCAGCCTCCACCAAGGGCCCATCGGTC

TTCCCCCTGGCGCCCTGCTCCAGGAGCACCTCCGAGAGCACAGCGGCCCTGGGCTGCCTGGTCAAGGACTACTTCCCT

GAACCGGTGACGGTGTCGTGGAACTCAGGCGCTCTGACCAGCGGCGTGCACACCTTCCCGGCTGTCCTACAGTCCTCA

GGACTCTACTCCCTCAGCAGCGTGGTGACCGTGCCCTCCAGCAACTTCGGCACCCAGACCTACACCTGCAACGTAGAT

CACAAGCCCAGCAATACCAAGGTGGACAAGACAGTTGAGCGCAAATGTTGTGTCGAGTGCCCACCGTGCCCAGCACCA

CCTGTGGCAGGACCGTCAGTCTTCCTCTTCCCCCCAAAACCCAAGGACACCCTCATGATCTCCCGGACCCCTGAGGTC

ACGTGCGTGGTGGTGGACGTGAGCCACGAAGACCCCGAGGTCCAGTTCAACTGGTACGTGGACGGCGTGGAGGTGCAT

-continued

AATGCCAAGACAAAGCCACGGGAGGAGCAGTTCCAAAGCACGTTCCGTGTGGTCAGCGTCCTCACCGTCGTGCACCAG

GACTGGCTGAACGGCAAGGAGTACAAGTGCAAGGTCTCCAACAAAGGCCTCCCAGCCCCCATCGAGAAAACCATCTCC

AAAACCAAAGGGCAGCCCCGAGAACCACAGGTGTACACCCTGCCCCCATCCCGGGAGGAGATGACCAAGAACCAGGTC

AGCCTGACCTGCCTGGTCAAAGGCTTCTACCCCAGCGACATCGCCGTGGAGTGGGAGAGCAATGGGCAGCCGGAGAAC

AACTACAAGACCACGCCTCCCATGCTGGACTCCGACGGCTCCTTCTTCCTCTACAGCAAGCTCACCGTGGACAAGAGC

AGGTGGCAGCAGGGGAACGTCTTCTCATGCTCCGTGATGCATGAGGCTCTGCACAACCACTACACGCAGAAGAGCCTC

TCCCTGTCTCCGGGT

SEQ ID NO. 204
ATGGAGACAGACACACTCCTGCTATGGGTACTGCTGCTCTGGGTTCCAGGTTCCACTGGTGACATCCAGATGACCCAG

TCTCCATCCTCCCTGTCTGCATCTGTAGGAGACAGAGTCACCATCACTTGCCAGGCGAGTCAGGACATCAGCAACTAT

TTAAATTGGTATCAGCAGAAACCAGGGAAAGCCCCTAAACTCCTGATCTACGATGCATCCAATTTGGAAACAGGGGTC

CCATCAAGGTTCAGTGGAAGTGGATCTGGGACAGATTTTACTTTCACCATCAGCAGCCTGCAGCCTGAAGATATTGCA

ACATATTTCTGTCAACACTTTGATCATCTCCCGCTCGCTTTCGGCGGAGGGACCAAGGTGGAGATCAAACGAACTGTG

GCTGCACCATCTGTCTTCATCTTCCCGCCATCTGATGAGCAGTTGAAATCTGGAACTGCCTCTGTTGTGTGCCTGCTG

AATAACTTCTATCCCAGAGAGGCCAAAGTACAGTGGAAGGTGGATAACGCCCTCCAATCGGGTAACTCCCAGGAGAGT

GTCACAGAGCAGGACAGCAAGGACAGCACCTACAGCCTCAGCAGCACCCTGACGCTGAGCAAAGCAGACTACGAGAAA

CACAAAGTCTACGCCTGCGAAGTCACCCATCAGGGCCTGAGCTCGCCCGTCACAAAGAGCTTCAACAGGGGAGAGTGT

SEQ ID NO. 205
ATGGAGACAGACACACTCCTGCTATGGGTACTGCTGCTCTGGGTTCCAGGTTCCACTGGTGACATCCAGATGACCCAG

TCTCCATCCTCCCTGTCTGCATCTGTAGGAGACAGAGTCACCATCACTTGCCAGGCGAGTCAGGACATCAGCAACTAT

TTAAATTGGTATCAGCAGAAACCAGGGAAAGCCCCTAAACTCCTGATCTACGATGCATCCAATTTGGAAACAGGGGTC

CCATCAAGGTTCAGTGGAAGTGGATCTGGGACAGATTTTACTTTCACCATCAGCAGCCTGCAGCCTGAAGATATTGCA

ACATATTTCTGTCAACACTTTGATCATCTCCCGCTCGCTTTCGGCGGAGGGACCAAGGTGGAGATCAAACGAACTGTG

GCTGCACCATCTGTCTTCATCTTCCCGCCATCTGATGAGCAGTTGAAATCTGGAACTGCCTCTGTTGTGTGCCTGCTG

AATAACTTCTATCCCAGAGAGGCCAAAGTACAGTGGAAGGTGGATAACGCCCTCCAATCGGGTAACTCCCAGGAGAGT

GTCACAGAGCAGGACAGCAAGGACAGCACCTACAGCCTCAGCAGCACCCTGACGCTGAGCAAAGCAGACTACGAGAAA

CACAAAGTCTACGCCTGCGAAGTCACCCATCAGGGCCTGAGCTCGCCCGTCACAAAGAGCTTCAACAGGGGAGAGTGT

GACAAAACTCACACATCGCCACCGTCCCCAGCACCTGAAGCGCGGGGGGACCGTCAGAAGTCAGGCCCGAGGAACCT

CTAGTGGTGAAGGTGGAAGAGGGAGATAACGCTGTGCTGCAGTGCCTCAAGGGGACCTCAGATGGCCCCACTCAGCAG

CTGACCTGGTCTCGGGAGTCCCCGCTTAAACCCTTCTTAAAACTCAGCCTGGGGCTGCCAGGCCTGGGAATCCACATG

AGGCCCCTGGCCATCTGGCTTTTCATCTTCAACGTCTCTCAACAGATGGGGGGCTTCTACCTGTGCCAGCCGGGGCCC

CCCTCTGAGAAGGCCTGGCAGCCTGGCTGGACAGTCAATGTGGAGGGCAGCGGG

SEQ ID NO. 206
ATGGAGTTTGGGCTGAGCTGGGTTTTCCTCGTTGCTCTTTTTAGAGGTGTCCAGTGTCAGGTGCAGCTGCAGGAGTCG

GGCCCAGGACTGGTGAAGCCTTCGGAGACCCTGTCCCTCACCTGCACTGTCTCTGGTGGCTCCGTCAGCAGTGGTGAT

TACTACTGGACCTGGATCCGGCAGTCCCCAGGGAAGGGACTGGAGTGGATTGGACACATCTATTACAGTGGGAACACC

AATTATAACCCCTCCCTCAAGAGTCGACTCACCATATCAATTGACACGTCCAAGACTCAGTTCTCCCTGAAGCTGAGT

TCTGTGACCGCTGCGGACACGGCCATTTATTACTGTGTGCGAGATCGAGTGACTGGTGCTTTTGATATCTGGGGCCAA

GGGACAATGGTCACCGTCTCTTCAGCCTCCACCAAGGGCCCATCGGTCTTCCCCCTGGCGCCCTGCTCCAGGAGCACC

TCCGAGAGCACAGCGGCCCTGGGCTGCCTGGTCAAGGACTACTTCCCTGAACCGGTGACGGTGTCGTGGAACTCAGGC

GCTCTGACCAGCGGCGTGCACACCTTCCCGGCTGTCCTACAGTCCTCAGGACTCTACTCCCTCAGCAGCGTGGTGACC

GTGCCCTCCAGCAACTTCGGCACCCAGACCTACACCTGCAACGTAGATCACAAGCCCAGCAATACCAAGGTGGACAAG

-continued

ACAGTTGAGCGCAAATGTTGTGTCGAGTGCCCACCGTGCCCAGCACCACCTGTGGCAGGACCGTCAGTCTTCCTCTTC

CCCCCAAAACCCAAGGACACCCTCATGATCTCCCGGACCCCTGAGGTCACGTGCGTGGTGGTGGACGTGAGCCACGAA

GACCCCGAGGTCCAGTTCAACTGGTACGTGGACGGCGTGGAGGTGCATAATGCCAAGACAAAGCCACGGGAGGAGCAG

TTCCAAAGCACGTTCCGTGTGGTCAGCGTCCTCACCGTCGTGCACCAGGACTGGCTGAACGGCAAGGAGTACAAGTGC

AAGGTCTCCAACAAAGGCCTCCCAGCCCCCATCGAGAAAACCATCTCCAAAACCAAAGGGCAGCCCCGAGAACCACAG

GTGTACACCCTGCCCCCATCCCGGAGGAGATGACCAAGAACCAGGTCAGCCTGACCTGCCTGGTCAAAGGCTTCTAC

CCCAGCGACATCGCCGTGGAGTGGGAGAGCAATGGGCAGCCGGAGAACAACTACAAGACCACGCCTCCCATGCTGGAC

TCCGACGGCTCCTTCTTCCTCTACAGCAAGCTCACCGTGGACAAGAGCAGGTGGCAGCAGGGGAACGTCTTCTCATGC

TCCGTGATGCATGAGGCTCTGCACAACCACTACACGCAGAAGAGCCTCTCCCTGTCTCCGGGTGGTGGAGGTGGGTCT

GGAGGTGGAGGATCTGGTGGAGGTGGGTCTGAAGTCAGGCCCGAGGAACCTCTAGTGGTGAAGGTGGAAGAGGGAGAT

AACGCTGTGCTGCAGTGCCTCAAGGGGACCTCAGATGGCCCCACTCAGCAGCTGACCTGGTCTCGGGAGTCCCCGCTT

AAACCCTTCTTAAAACTCAGCCTGGGGCTGCCAGGCCTGGGAATCCACATGAGGCCCCTGGCCATCTGGCTTTTCATC

TTCAACGTCTCTCAACAGATGGGGGGCTTCTACCTGTGCCAGCCGGGGCCCCCCTCTGAGAAGGCCTGGCAGCCTGGC

TGGACAGTCAATGTGGAGGGCAGCGGG

SEQ ID NO. 207
ATGGAGTTTGGGCTGAGCTGGGTTTTCCTCGTTGCTCTTTTTAGAGGTGTCCAGTGTCAGGTTCAGCTGGTGCAGTCT

GGTGCTGAGGTGAAGAAGCCTGGTGCCTCAGTGAAGGTCTCCTGCAAGGCTTCTGGTTACACATTCACTGACTACTAC

ATGCACTGGGTGCGTCAGGCCCCTGGTCAAGGTCTTGAGTGGATGGGTCGTGTTAATCCTAACCGGAGGGGTACTACC

TACAACCAGAAATTCGAGGGCCGTGTCACCATGACCACAGACACATCCACGAGCACAGCCTACATGGAGCTGCGTAGC

CTGCGTTCTGACGACACGGCCGTGTATTACTGTGCGCGTGCGAACTGGCTTGACTACTGGGGCCAGGGCACCACCGTC

ACCGTCTCCTCCGCCTCCACCAAGGGCCCATCGGTCTTCCCGCTAGCGCCCTGCTCCAGGAGCACCTCCGAGAGCACA

GCCGCCCTGGGCTGCCTGGTCAAGGACTACTTCCCCGAACCGGTGACGGTGTCGTGGAACTCAGGCGCCCTGACCAGC

GGCGTGCACACCTTCCCGGCTGTCCTACAGTCCTCAGGACTCTACTCCCTCAGCAGCGTGGTGACCGTGCCCTCCAGC

AGCTTGGGCACGAAGACCTACACCTGCAACGTAGATCACAAGCCCAGCAACACCAAGGTGGACAAGAGAGTTGAGTCC

AAATATGGTCCCCCATGCCCACCCTGCCCAGCACCTGAGGCCGCCGGGGGACCATCAGTCTTCCTGTTCCCCCCAAAA

CCCAAGGACACTCTCATGATCTCCCGGACCCCTGAGGTCACGTGCGTGGTGGTGGACGTGAGCCAGGAAGACCCCGAG

GTCCAGTTCAACTGGTACGTGGATGGCGTGGAGGTGCATAATGCCAAGACAAAGCCGCGGGAGGAGCAGTTCAACAGC

ACGTACCGTGTGGTCAGCGTCCTCACCGTCCTGCACCAGGACTGGCTGAACGGCAAGGAGTACAAGTGCAAGGTCTCC

AACAAAGGCCTCCCGTCCTCCATCGAGAAAACCATCTCCAAAGCCAAAGGGCAGCCCCGAGAGCCACAGGTGTACACC

CTGCCCCCATCCCAGGAGGAGATGACCAAGAACCAGGTCAGCCTGACCTGCCTGGTCAAAGGCTTCTACCCCAGCGAC

ATCGCCGTGGAGTGGGAAAGCAATGGGCAGCCGGAGAACAACTACAAGACCACGCCTCCCGTGCTGGACTCCGACGGC

TCCTTCTTCCTCTACAGCAGGCTAACCGTGGACAAGAGCAGGTGGCAGGAGGGGAATGTCTTCTCATGCTCCGTGATG

CATGAGGCTCTGCACAACCACTACACACAGAAGAGCCTCTCCCTGTCTCTGGGT

SEQ ID NO. 208
ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

GCCATCTGGCTTTTCATCTTCAACGTCTCTCAACAGATGGGGGGCTTCTACCTGTGCCAGCCGGGGCCCCCCTCTGAG

AAGGCCTGGCAGCCTGGCTGGACAGTCAATGTGGAGGGCAGCGGGGAGGTGGGTCTGGAGGTGGAGGATCTGGTGGA

GGTGGGTCTGACATCCAGATGACCCAGTCTCCATCCTCCCTGTCTGCATCTGTAGGAGACAGAGTCACCATCACTTGC

AGTGTCAGCTCAAGTGTATCCTCCATTTACTTGCACTGGTATCAGCAGAAACCAGGGAAAGCCCCTAAGCTCCTGATC

TATAGCACATCCAACTTGGCTTCTGGAGTCCCATCAAGGTTCAGTGGCAGTGGATCTGGGACAGATTTCACTCTCACC

-continued

ATCAGCAGTCTGCAACCTGAAGATTTTGCAACTTACTACTGTCAAGTCTACAGTGGTTACCCGCTCACGTTCGGCGGA

GGGACCAAGGTGGAGATCAAACGAACTGTGGCTGCACCATCTGTCTTCATCTTCCCGCCATCTGATGAGCAGTTGAAA

TCTGGAACTGCCTCTGTTGTGTGCCTGCTGAATAACTTCTATCCCAGAGAGGCCAAAGTACAGTGGAAGGTGGATAAC

GCCCTCCAATCGGGTAACTCCCAGGAGAGTGTCACAGAGCAGGACAGCAAGGACAGCACCTACAGCCTCAGCAGCACC

CTGACGCTGAGCAAAGCAGACTACGAGAAACACAAAGTCTACGCCTGCGAAGTCACCCATCAGGGCCTGAGCTCGCCC

GTCACAAAGAGCTTCAACAGGGGAGAGTGCTAATA

SEQ ID NO. 209
ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

GCCATCTGGCTTTTCATCTTCAACGTCTCTCAACAGATGGGGGGCTTCTACCTGTGCCAGCCGGGGCCCCCCTCTGAG

AAGGCCTGGCAGCCTGGCTGGACAGTCAATGTGGAGGGCAGCGGGGAGGTGGGTCTGGAGGTGGAGGATCTGGTGGA

GGTGGGTCTCAGGTTCAGCTGGTGCAGTCTGGTGCTGAGGTGAAGAAGCCTGGTGCCTCAGTGAAGGTCTCCTGCAAG

GCTTCTGGTTACACATTCACTGACTACTACATGCACTGGGTGCGTCAGGCCCCTGGTCAAGGTCTTGAGTGGATGGGT

CGTGTTAATCCTAACCGGAGGGGTACTACCTACAACCAGAAATTCGAGGGCCGTGTCACCATGACCACAGACACATCC

ACGAGCACAGCCTACATGGAGCTGCGTAGCCTGCGTTCTGACGACACGGCCGTGTATTACTGTGCGCGTGCGAACTGG

CTTGACTACTGGGGCCAGGGCACCACCGTCACCGTCTCCTCCGCCTCCACCAAGGGCCCATCGGTCTTCCCGCTAGCG

CCCTGCTCCAGGAGCACCTCCGAGAGCACAGCCGCCCTGGGCTGCCTGGTCAAGGACTACTTCCCCG

AACCGGTGACGGTGTCGTGGAACTCAGGCGCCCTGACCAGCGGCGTGCACACCTTCCCGGCTGTCCTACAGTCCTCAG

GACTCTACTCCCTCAGCAGCGTGGTGACCGTGCCCTCCAGCAGCTTGGGCACGAAGACCTACACCTGCAACGTAGATC

ACAAGCCCAGCAACACCAAGGTGGACAAGAGAGTTGAGTCCAAATATGGTCCCCCATGCCCACCCTGCCCAGCACCTG

AGGCCGCCGGGGGACCATCAGTCTTCCTGTTCCCCCCAAAACCCAAGGACACTCTCATGATCTCCCGGACCCCTGAGG

TCACGTGCGTGGTGGTGGACGTGAGCCAGGAAGACCCCGAGGTCCAGTTCAACTGGTACGTGGATGGCGTGGAGGTGC

ATAATGCCAAGACAAAGCCGCGGGAGGAGCAGTTCAACAGCACGTACCGTGTGGTCAGCGTCCTCACCGTCCTGCACC

AGGACTGGCTGAACGGCAAGGAGTACAAGTGCAAGGTCTCCAACAAAGGCCTCCCGTCCTCCATCGAGAAAACCATCT

CCAAAGCCAAAGGGCAGCCCCGAGAGCCACAGGTGTACACCCTGCCCCCATCCCAGGAGGAGATGACCAAGAACCAGG

TCAGCCTGACCTGCCTGGTCAAAGGCTTCTACCCCAGCGACATCGCCGTGGAGTGGGAAAGCAATGGGCAGCCGGAGA

ACAACTACAAGACCACGCCTCCCGTGCTGGACTCCGACGGCTCCTTCTTCCTCTACAGCAGGCTAACCGTGGACAAGA

GCAGGTGGCAGGAGGGGAATGTCTTCTCATGCTCCGTGATGCATGAGGCTCTGCACAACCACTACACACAGAAGAGCC

TCTCCCTGTCTCTG

SEQ ID NO. 210
ATGGAGACAGACACACTCCTGCTATGGGTACTGCTGCTCTGGGTTCCAGGTTCCACTGGTGACATCCAGATGACCCAG

TCTCCATCCTCCCTGTCTGCATCTGTAGGAGACAGAGTCACCATCACTTGCAGTGTCAGCTCAAGTGTATCCTCCATT

TACTTGCACTGGTATCAGCAGAAACCAGGGAAAGCCCCTAAGCTCCTGATCTATAGCACATCCAACTTGGCTTCTGGA

GTCCCATCAAGGTTCAGTGGCAGTGGATCTGGGACAGATTTCACTCTCACCATCAGCAGTCTGCAACCTGAAGATTTT

GCAACTTACTACTGTCAAGTCTACAGTGGTTACCCGCTCACGTTCGGCGGAGGGACCAAGGTGGAGATCAAACGAACT

GTGGCTGCACCATCTGTCTTCATCTTCCCGCCATCTGATGAGCAGTTGAAATCTGGAACTGCCTCTGTTGTGTGCCTG

CTGAATAACTTCTATCCCAGAGAGGCCAAAGTACAGTGGAAGGTGGATAACGCCCTCCAATCGGGTAACTCCCAGGAG

AGTGTCACAGAGCAGGACAGCAAGGACAGCACCTACAGCCTCAGCAGCACCCTGACGCTGAGCAAAGCAGACTACGAG

AAACACAAAGTCTACGCCTGCGAAGTCACCCATCAGGGCCTGAGCTCGCCCGTCACAAAGAGCTTCAACAGGGGAGAG

TGC

```
                                                                       SEQ ID NO. 211
ATGGAGACAGACACACTCCTGCTATGGGTACTGCTGCTCTGGGTTCCAGGTTCCACTGGTGACATCCAGATGACCCAG

TCTCCATCCTCCCTGTCTGCATCTGTAGGAGACAGAGTCACCATCACTTGCAGTGTCAGCTCAAGTGTATCCTCCATT

TACTTGCACTGGTATCAGCAGAAACCAGGGAAAGCCCCTAAGCTCCTGATCTATAGCACATCCAACTTGGCTTCTGGA

GTCCCATCAAGGTTCAGTGGCAGTGGATCTGGGACAGATTTCACTCTCACCATCAGCAGTCTGCAACCTGAAGATTTT

GCAACTTACTACTGTCAAGTCTACAGTGGTTACCCGCTCACGTTCGGCGGAGGGACCAAGGTGGAGATCAAACGAACT

GTGGCTGCACCATCTGTCTTCATCTTCCCGCCATCTGATGAGCAGTTGAAATCTGGAACTGCCTCTGTTGTGTGCCTG

CTGAATAACTTCTATCCCAGAGAGGCCAAAGTACAGTGGAAGGTGGATAACGCCCTCCAATCGGGTAACTCCCAGGAG

AGTGTCACAGAGCAGGACAGCAAGGACAGCACCTACAGCCTCAGCAGCACCCTGACGCTGAGCAAAGCAGACTACGAG

AAACACAAAGTCTACGCCTGCGAAGTCACCCATCAGGGCCTGAGCTCGCCCGTCACAAAGAGCTTCAACAGGGGAGAG

TGCGACAAAACTCACACATCGCCACCGTCCCCAGCACCTGAAGCCGCGGGGGACCGTCAGAAGTCAGGCCCGAGGAA

CCTCTAGTGGTGAAGGTGGAAGAGGGAGATAACGCTGTGCTGCAGTGCCTCAAGGGGACCTCAGATGGCCCCACTCAG

CAGCTGACCTGGTCTCGGGAGTCCCCGCTTAAACCCTTCTTAAAACTCAGCCTGGGGCTGCCAGGCCTGGGAATCCAC

ATGAGGCCCCTGGCCATCTGGCTTTTCATCTTCAACGTCTCTCAACAGATGGGGGCTTCTACCTGTGCCAGCCGGGG

CCCCCCTCTGAGAAGGCCTGGCAGCCTGGCTGGACAGTCAATGTGGAGGGCAGCGGG

SEQ ID NO. 212
ATGGAGTTTGGGCTGAGCTGGGTTTTCCTCGTTGCTCTTTTTAGAGGTGTCCAGTGTCAGGTTCAGCTGGTGCAGTCT

GGTGCTGAGGTGAAGAAGCCTGGTGCCTCAGTGAAGGTCTCCTGCAAGGCTTCTGGTTACACATTCACTGACTACTAC

ATGCACTGGGTGCGTCAGGCCCCTGGTCAAGGTCTTGAGTGGATGGGTCGTGTTAATCCTAACCGGAGGGGTACTACC

TACAACCAGAAATTCGAGGGCCGTGTCACCATGACCACAGACACATCCACGAGCACAGCCTACATGGAGCTGCGTAGC

CTGCGTTCTGACGACACGGCCGTGTATTACTGTGCGCGTGCGAACTGGCTTGACTACTGGGGCCAGGGCACCACCGTC

ACCGTCTCCTCCGCCTCCACCAAGGGCCCATCGGTCTTCCCGCTAGCGCCCTGCTCCAGGAGCACCTCCGAGAGCACA

GCCGCCCTGGGCTGCCTGGTCAAGGACTACTTCCCCGAACCGGTGACGGTGTCGTGGAACTCAGGCGCCCTGACCAGC

GGCGTGCACACCTTCCCGGCTGTCCTACAGTCCTCAGGACTCTACTCCCTCAGCAGCGTGGTGACCGTGCCCTCCAGC

AGCTTGGGCACGAAGACCTACACCTGCAACGTAGATCACAAGCCCAGCAACACCAAGGTGGACAAGAGAGTTGAGTCC

AAATATGGTCCCCCATGCCCACCCTGCCCAGCACCTGAGGCCGCCGGGGGACCATCAGTCTTCCTGTTCCCCCCAAAA

CCCAAGGACACTCTCATGATCTCCCGGACCCCTGAGGTCACGTGCGTGGTGGTGGACGTGAGCCAGGAAGACCCCGAG

GTCCAGTTCAACTGGTACGTGGATGGCGTGGAGGTGCATAATGCCAAGACAAAGCCGCGGGAGGAGCAGTTCAACAGC

ACGTACCGTGTGGTCAGCGTCCTCACCGTCCTGCACCAGGACTGGCTGAACGGCAAGGAGTACAAGTGCAAGGTCTCC

AACAAAGGCCTCCCGTCCTCCATCGAGAAAACCATCTCCAAAGCCAAAGGGCAGCCCCGAGAGCCACAGGTGTACACC

CTGCCCCCATCCCAGGAGGAGATGACCAAGAACCAGGTCAGCCTGACCTGCCTGGTCAAAGGCTTCTACCCCAGCGAC

ATCGCCGTGGAGTGGGAAAGCAATGGGCAGCCGGAGAACAACTACAAGACCACGCCTCCCGTGCTGGACTCCGACGGC

TCCTTCTTCCTCTACAGCAGGCTAACCGTGGACAAGAGCAGGTGGCAGGAGGGGAATGTCTTCTCATGCTCCGTGATG

CATGAGGCTCTGCACAACCACTACACACAGAAGAGCCTCTCCCTGTCTCTGGGTGGTGGAGGTGGGTCTGGAGGTGGA

GGATCTGGTGGAGGTGGGTCTGAAGTCAGGCCCGAGGAACCTCTAGTGGTGAAGGTGGAAGAGGGAGATAACGCTGTG

CTGCAGTGCCTCAAGGGGACCTCAGATGGCCCCACTCAGCAGCTGACCTGGTCTCGGGAGTCCCCGCTTAAACCCTTC

TTAAAACTCAGCCTGGGGCTGCCAGGCCTGGGAATCCACATGAGGCCCCTGGCCATCTGGCTTTTCATCTTCAACGTC

TCTCAACAGATGGGGGCTTCTACCTGTGCCAGCCGGGGCCCCCCTCTGAGAAGGCCTGGCAGCCTGGCTGGACAGTC

AATGTGGAGGGCAGCGGG

SEQ ID NO. 213
ATGGAGACAGACACACTCCTGCTATGGGTACTGCTGCTCTGGGTTCCAGGTTCCACTGGTGACATCCAGATGACACAG

ACTACATCCTCCCTGTCTGCCTCTCTGGGAGACAGAGTCACCATCAGTTGCAGGGCAAGTCAGGACATTAGTAAATAT
```

-continued

TTAAATTGGTATCAGCAGAAACCAGATGGAACTGTTAAACTCCTGATCTACCATACATCAAGATTACACTCAGGAGTC

CCATCAAGGTTCAGTGGCAGTGGGTCTGGAACAGATTATTCTCTCACCATTAGCAACCTGGAGCAAGAAGATATTGCC

ACTTACTTTTGCCAACAGGGTAATACGCTTCCGTACACGTTCGGAGGGGGGACTAAGTTGGAAATAACAGGAGGAGGT

GGGTCTGGAGGTGGAGGATCTGGTGGAGGTGGGTCTGGAGGAGGTGGGTCTGAGGTGAAACTGCAGGAGTCAGGACCT

GGCCTGGTGGCGCCCTCACAGAGCCTGTCCGTCACATGCACTGTCTCAGGGGTCTCATTACCCGACTATGGTGTAAGC

TGGATTCGCCAGCCTCCACGAAAGGGTCTGGAGTGGCTGGGAGTAATATGGGGTAGTGAAACCACATACTATAATTCA

GCTCTCAAATCCAGACTGACCATCATCAAGGACAACTCCAAGAGCCAAGTTTTCTTAAAAATGAACAGTCTGCAAACT

GATGACACAGCCATTTACTACTGTGCCAAACATTATTACTACGGTGGTAGCTATGCTATGGACTACTGGGGTCAAGGA

ACCTCAGTCACCGTCTCCTCACCGAGCCAGTTCCGGGTGTCGCCGCTGGATCGGACCTGGAACCTGGGCGAGACAGTG

GAGCTGAAGTGCCAGGTGCTGCTGTCCAACCCGACGTCGGGCTGCTCGTGGCTCTTCCAGCCGCGCGGCGCCGCCGCC

AGTCCCACCTTCCTCCTATACCTCTCCCAAAACAAGCCCAAGGCGGCCGAGGGGCTGGACACCCAGCGGTTCTCGGGC

AAGAGGTTGGGGGACACCTTCGTCCTCACCCTGAGCGACTTCCGCCGAGAGAACGAGGGCTACTATTTCTGCTCGGCC

CTGAGCAACTCCATCATGTACTTCAGCCACTTCGTGCCGGTCTTCCTGCCAGCGAAGCCCACCACGACGCCAGCGCCG

CGACCACCAACACCGGCGCCCACCATCGCGTCGCAGCCCCTGTCCCTGCGCCCAGAGGCGTGCCGGCCAGCGGCGGGG

GGCGCAGTGCACACGAGGGGGCTGGACTTCGCCTGTGATATCTACATCTGGGCGCCCTTGGCCGGGACTTGTGGGGTC

CTTCTCCTGTCACTGGTTATCACCAGGAGTAAGAGGAGCAGGCTCCTGCACAGTGACTACATGAACATGACTCCCCGC

CGCCCCGGGCCCACCCGCAAGCATTACCAGCCCTATGCCCCACCACGCGACTTCGCAGCCTATCGCTCCAAACGGGGC

AGAAAGAAACTCCTGTATATATTCAAACAACCATTTATGAGACCAGTACAAACTACTCAAGAGGAAGATGGCTGTAGC

TGCCGATTTCCAGAAGAAGAAGAAGGAGGATGTGAACTGAGAGTGAAGTTCAGCAGGAGCGCAGACGCCCCCGCGTAC

CAGCAGGGCCAGAACCAGCTCTATAACGAGCTCAATCTAGGACGAAGAGAGGAGTACGATGTTTTGGACAAGAGACGT

GGCCGGGACCCTGAGATGGGGGGAAAGCCGCAGAGAAGGAAGAACCCTCAGGAAGGCCTGTACAATGAACTGCAGAAA

GATAAGATGGCGGAGGCCTACAGTGAGATTGGGATGAAAGGCGAGCGCCGGAGGGGCAAGGGGCACGATGGCCTTTAC

CAGGGTCTCAGTACAGCCACCAAGGACACCTACGACGCCCTTCACATGCAGGCCCTGCCCCCTCGC

SEQ ID NO. 214
ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

GCCATCTGGCTTTTCATCTTCAACGTCTCTCAACAGATGGGGGGCTTCTACCTGTGCCAGCCGGGGCCCCCCTCTGAG

AAGGCCTGGCAGCCTGGCTGGACAGTCAATGTGGAGGGCAGCGGGCATCATCACCATCACCAT

SEQ ID NO. 215
ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

GCCATCTGGCTTTTCATCTTCAACGTCTCTCAACAGATGGGGGGCTTCTACCTGTGCCAGCCGGGGCCCCCCTCTGAG

AAGGCCTGGCAGCCTGGCTGGACAGTCAATGTGGAGGGCAGCGGGGACAAAACTCACACATGCCCACCGTGCCCAGCA

CCTGAACTCCTGGGGGGACCGTCAGTCTTCCTCTTCCCCCCAAAACCCAAGGACACCCTCATGATCTCCCGGACCCCT

GAGGTCACATGCGTGGTGGTGGACGTGAGCCACGAAGACCCTGAGGTCAAGTTCAACTGGTACGTGGACGGCGTGGAG

GTGCATAATGCCAAGACAAAGCCGCGGGAGGAGCAGTACAACAGCACGTACCGTGTGGTCAGCGTCCTCACCGTCCTG

CACCAGGACTGGCTGAATGGCAAGGAGTACAAGTGCAAGGTCTCCAACAAAGCCCTCCCAGCCCCCATCGAGAAAACC

ATCTCCAAAGCCAAAGGGCAGCCCCGAGAACCACAGGTGTACACCCTGCCCCCATCCCGGGAGGAGATGACCAAGAAC

CAGGTCAGCCTGACCTGCCTGGTCAAAGGCTTCTATCCCAGCGACATCGCCGTGGAGTGGGAGAGCAATGGGCAGCCG

GAGAACAACTACAAGACCACGCCTCCCGTGCTGGACTCCGACGGCTCCTTCTTCCTCTACAGCAAGCTCACCGTGGAC

-continued

AAGAGCAGGTGGCAGCAGGGGAACGTCTTCTCATGCTCCGTGATGCACGAGGCTCTGCACAACCACTACACGCAGAAG
AGCCTCTCCCTGTCTCCGGGT

SEQ ID NO. 216
ATGGAGTTTGGGCTGAGCTGGGTTTTCCTCGTTGCTCTTTTTAGAGGTGTCCAGTGTGAGGTGCAGCTGGTGGAGTCT
GGTGGTGGTCTTGTTCAACCTGGTGGTTCTCTTCGTCTTTCTTGTGCTGCTTCTGGTTTTAATATTAAAGATACTTAT
ATTCATTGGGTTCGTCAAGCTCCTGGTAAAGGTCTTGAATGGGTTGCTCGTATTTATCCTACTAATGGTTATACTCGT
TATGCTGATTCTGTTAAAGGTCGTTTTACTATTTCTGCTGATACTTCTAAAAATACTGCTTATCTTCAAATGAACTCT
CTTCGTGCTGAAGATACTGCTGTTTATTATTGTTCTCGTTGGGGTGGTGATGGTTTTTATGCTATGGATTATTGGGGT
CAAGGTACTCTTGTCACCGTCTCCTCAGCTAGCACCGGGGAGGTGGGTCTGGAGGTGGAGGATCGGTGGAGGTGGG
TCTGACATCCAGATGACCCAGTCTCCTTCTTCTCTTTCTGCTTCTGTTGGTGATCGTGTTACTATTACTTGTCGTGCT
TCTCAAGATGTTAATACTGCTGTTGCTTGGTATCAACAAAAACCTGGTAAAGCTCCTAAACTTCTTATTTATTCTGCT
TCTTTTCTTTATTCTGGTGTTCCTTCCGTTTTTCTGGTTCTCGTTCTGGTACTGATTTTACTCTTACTATTTCTTCT
CTTCAACCTGAAGATTTTGCTACTTATTATTGTCAACAACATTATACTACTCCTCCTACTTTTGGTCAAGGTACCAAG
GTGGAGATCAAACGTACGGGGCCCCATCATCACCATCACCAT

SEQ ID NO. 217
ATGGAGTTTGGGCTGAGCTGGGTTTTCCTCGTTGCTCTTTTTAGAGGTGTCCAGTGTCAGGTGCAGCTGGTGCAGAGC
GGCGCCGAGGACAAGAAGCCCGGCGAGAGCGTGAAGATCAGCTGCAAGGCCAGCGGCTACACCTTCACCAACTACGGC
ATGAACTGGGTGAGGCAGGCCCCCGGCCAGGGCCTGAAGTGGATGGGCTGGATCAACACCTACACCGGCGAGAGCACC
TACGCCGACGACTTCAAGGGCAGGTTCGCCTTCAGCCTGGACACCAGCGCCAGCACCGCCTACCTGCAGCTGAGCAGC
CTGAGGGGCGAGGACACCGCCGTGTACTTCTGCGCCAGGTTCGCCATCAAGGGCGACTACTGGGGCCAGGGCACCACC
GTGACCGTGAGCAGCGCCAGCACCGGCGGCGGCGGCAGCGGCGGCGGCGGCAGCGGCGGCGGCGGCAGCGGCGGCGGC
GGCAGCGACATCGTGATGACCCAGAGCCCCCTGAGCCTGGAGGTGAGCCCCGGCGAGCCCGCCAGCATCAGCTGCAGG
AGCACCAAGAGCCTGCTGCACAGCGACGGCATCACCTACCTGTACTGGTACCTGCAGAAGCCCGGCCAGAGCCCCCAG
CTGCTGATCTACCAGCTGAGCAACCTGGCCAGCGGCGTGCCCGACAGGTTCAGCAGCAGCGGCAGCGGCACCGACTTC
ACCCTGAAGATCAGCAGGGTGGAGGCCGAGGACGAGGGCACCTACTACTGCGCCCAGAACCTGGAGATCCCCAGGACC
TTCGGCCAGGGCACCAAGCTGGAGATCAAGAGGACCGGGCCCCATCATCACCATCACCAT

SEQ ID NO. 218
ATGGAGACAGACACACTCCTGCTATGGGTACTGCTGCTCTGGGTTCCAGGTTCCACTGGTGACATCGTGATGACCCAG
AGCCCCCTGAGCCTGCCCGTGACCCCCGGCGAGCCCGCCAGCATCAGCTGCAGGAGCACCAAGAGCCTGCTGCACAGC
GACGGCATCACCTACCTGTACTGGTACCTGCAGAAGCCCGGCCAGAGCCCCCAGCTGCTGATCTACCAGCTGAGCAAC
CTGGCCAGCGGCGTGCCCGACAGGTTCAGCAGCAGCGGCAGCGGCACCGACTTCACCCTGAAGATCAGCAGGGTGGAG
GCCGAGGACGAGGGCGTGTACTACTGCGCCCAGAACCTGGAGATCCCCAGGACCTTCGGCTGCGGCACCAAGCTGGAG
ATCAAGAGGACCGGCGGCGGCGGCAGCGGCGGCGGCGGCAGCGGCGGCGGCGGCAGCGGCGGCGGCAGCCAGGTG
CAGCTGGTGCAGAGCGGCGCCGAGGTGAAGAAGCCCGGCGAGAGCGTGAAGATCAGCTGCAAGGCCAGCGGCTACACC
TTCACCAACTACGGCATGAACTGGGTGAGGCAGGCCCCCGGCCAGTGCCTGAAGTGGATGGGCTGGATCAACACCTAC
ACCGGCGAGAGCACCTACGCCGACGACTTCAAGGGCAGGTTCGCCTTCAGCCTGGACACCAGCGCCAGCACCGCCTAC
CTGCAGCTGAGCAGCCTGAGGAGCGAGGACACCGCCGTGTACTTCTGCGCCAGGTTCGCCATCAAGGGCGACTACTGG
GGCCAGGGCACCCTGGTGACCGTGAGCAGCGGGCCCCATCATCACCATCACCAT

SEQ ID NO. 219
ATGGAGTTTGGGCTGAGCTGGGTTTTCCTCGTTGCTCTTTTTAGAGGTGTCCAGTGTCAGGTTCAGCTGGTGCAGTCT
GGTGCTGAGGATGTGAAGCCTGATGCCTCAGTGAAGCTCTCCTGCAAGGCTTCTGGTTACACATTCACTGACTACTAC
ATGCACTGGGTGCGTCAGGCCCCTGGTCAAGGTCTTGAGTGGATGGGTCGTGTTAATCCTAACCGGAGGGGTACTACC

-continued

TACAACCAGAAATTCGAGGGCCGTGTCACCATGACCACAGACACATCCACGAGCACAGCCTACATGCAGCTGAGTAGC
CTGCGTGGTGAAGACACGGCCGTGTATTACTGTGCGCGTGCGAACTGGCTTGACTACTGGGGCCAGGGCACCACCGTC
ACCGTCTCCTCCGCCTCCACCGGGGGAGGTGGGTCTGGAGGTGGAGGATCTGGTGGAGGTGGGTCTGGTGGAGGTGGG
TCTGACATCCAGATGACCCAGTCTCCATCCTCCCTGGAGGCATCTGTAGGAGACAGAGTCACCATCACTTGCAGTGTC
AGCTCAAGTGTATCCTCCATTTACTTGCACTGGTATCAGCAGAAACCAGGGAAAAGCCCTAAGCTCCTGATCTATAGC
ACATCCAACTTGGCTTCTGGAGTCCCAGATAGGTTCAGTGGCAGTGGATCTGGGACAGATTTCACTCTCACCATCAGC
AGTCTGCAAGCCGAAGATGAGGGCACTTACTACTGTCAAGTCTACAGTGGTTACCCGCTCACGTTCGGCGGAGGGACC
AAGCTGGAGATCAAACGAACTGGGCCCCATCATCACCATCACCAT

SEQ ID NO. 220
ATGGAGACAGACACACTCCTGCTATGGGTACTGCTGCTCTGGGTTCCAGGTTCCACTGGTGACATCCAGATGACCCAG
TCTCCATCCTCCCTGTCTGCATCTGTAGGAGACAGAGTCACCATCACTTGCAGTGTCAGCTCAAGTGTATCCTCCATT
TACTTGCACTGGTATCAGCAGAAACCAGGGAAAGCCCCTAAGCTCCTGATCTATAGCACATCCAACTTGGCTTCTGGA
GTCCCATCAAGGTTCAGTGGCAGTGGATCTGGGACAGATTTCACTCTCACCATCAGCAGTCTGCAACCTGAAGATGAA
GCAACTTACTACTGTCAAGTCTACAGTGGTTACCCGCTCACGTTCGGCTGCGGGACCAAGGTGGAGATCAAACGAACT
GGGGGAGGTGGGTCTGGAGGTGGAGGATCTGGTGGAGGTGGGTCTGGTGGAGGTGGGTCTCAGGTTCAGCTGGTGCAG
TCTGGTGCTGAGGATAAGAAGCCTGGTGCCTCAGTGAAGGTCTCCTGCAAGGCTTCTGGTTACACATTCACTGACTAC
TACATGCACTGGGTGCGTCAGGCCCCTGGTCAATGTCTTGAGTGGATGGGTCGTGTTAATCCTAACCGGAGGGGTACT
ACCTACAACCAGAAATTCGAGGGCCGTGTCACCATGACCACAGACACATCCACGAGCACAGCCTACATGGAGCTGCGT
AGCCTGCGTTCTGACGACACGGCCGTGTATTACTGTGCGCGTGCGAACTGGCTTGACTACTGGGGCCAGGGCACCACC
GTCACCGTCTCCTCCGGGCCCCATCATCACCATCACCAT

SEQ ID NO. 221
ATGGAGTTTGGGCTGAGCTGGGTTTTCCTCGTTGCTCTTTTTAGAGGTGTCCAGTGTCAGGTGCAGCTGCAGGAGAGC
GGCCCCGGCGACGTGAAGCCCAGCGAGACCCTGAGCCTGACCTGCACCGTGAGCGGCGGCAGCGTGAGCAGCGGCGAC
TACTACTGGACCTGGATCAGGCAGAGCCCCGGCAAGGGCCTGGAGTGGATCGGCCACATCTACTACAGCGGCAACACC
AACTACAACCCCAGCCTGAAGAGCAGGCTGACCATCAGCATCGACACCAGCAAGACCACCTTCAGCCTGCAGCTGAGC
AGCGTGACCGGCGAGGACACCGCCATCTACTACTGCGTGAGGGACAGGGTGACCGGCGCCTTCGACATCTGGGGCCAG
GGCACCACCGTGACCGTGAGCAGCGCCAGCACCGGCGGCGGCGGCAGCGGCGGCGGCGGCAGCGGCGGCGGCGGCAGC
GGCGGCGGCAGCGACATCCAGATGACCCAGAGCCCCAGCAGCCTGGAGGCCAGCGTGGGCGACAGGGTGACCATC
ACCTGCCAGGCCAGCCAGGACATCAGCAACTACCTGAACTGGTACCAGCAGAAGCCCGGCAAGAGCCCCAAGCTGCTG
ATCTACGACGCCAGCAACCTGGAGACCGGCGTGCCCGACAGGTTCAGCGGCAGCGGCAGCGGCACCGACTTCACCTTC
ACCATCAGCAGCCTGCAGGCCGAGGACGAGGGCACCTACTTCTGCCAGCACTTCGACCACCTGCCCCTGGCCTTCGGC
GGCGGCACCAAGCTGGAGATCAAGAGGACCGGGCCCCATCATCACCATCACCAT

SEQ ID NO. 222
ATGGAGACAGACACACTCCTGCTATGGGTACTGCTGCTCTGGGTTCCAGGTTCCACTGGTGACATCCAGATGACCCAG
AGCCCCAGCAGCCTGAGCGCCAGCGTGGGCGACAGGGTGACCATCACCTGCCAGGCCAGCCAGGACATCAGCAACTAC
CTGAACTGGTACCAGCAGAAGCCCGGCAAGGCCCCCAAGCTGCTGATCTACGACGCCAGCAACCTGGAGACCGGCGTG
CCCAGCAGGTTCAGCGGCAGCGGCAGCGGCACCGACTTCACCTTCACCATCAGCAGCCTGCAGCCCGAGGACGAGGCC
ACCTACTTCTGCCAGCACTTCGACCACCTGCCCCTGGCCTTCGGCTGCGGCACCAAGGTGGAGATCAAGAGGACCGGC
GGCGGCGGCAGCGGCGGCGGCGGCAGCGGCGGCGGCGGCAGCGGCGGCGGCAGCCAGGTGCAGCTGCAGGAGAGC
GGCCCCGGCGACGTGAAGCCCAGCGAGACCCTGAGCCTGACCTGCACCGTGAGCGGCGGCAGCGTGAGCAGCGGCGAC
TACTACTGGACCTGGATCAGGCAGAGCCCCGGCAAGTGCCTGGAGTGGATCGGCCACATCTACTACAGCGGCAACACC
AACTACAACCCCAGCCTGAAGAGCAGGCTGACCATCAGCATCGACACCAGCAAGACCCAGTTCAGCCTGAAGCTGAGC

-continued

AGCGTGACCGCCGCCGACACCGCCATCTACTACTGCGTGAGGGACAGGGTGACCGGCGCCTTCGACATCTGGGGCCAG

GGCACCACCGTGACCGTGAGCAGCGGGCCCCATCATCACCATCACCAT

SEQ ID NO. 223
ATGCCACCTCCTCGCCTCCTCTTCTTCCTCCTCTTCCTCACCCCCATGGAAGTCAGGCATCATCACCATCACCATCCC

GAGGAACCTCTAGTGGTGAAGGTGGAAGAGGGAGATAACGCTGTGCTGCAGTGCCTCAAGGGGACCTCAGATGGCCCC

ACTCAGCAGCTGACCTGGTCTCGGGAGTCCCCGCTTAAACCCTTCTTAAAACTCAGCCTGGGGCTGCCAGGCCTGGGA

ATCCACATGAGGCCCCTGGCCATCTGGCTTTTCATCTTCAACGTCTCTCAACAGATGGGGGGCTTCTACCTGTGCCAG

CCGGGGCCCCCCTCTGAGAAGGCCTGGCAGCCTGGCTGGACAGTCAATGTGGAGGGCAGCGGGGAGCTGTTCCGGTGG

AATGTTTCGGACCTAGGTGGCCTGGGCTGTGGCCTGAAGAACAGGTCCTCAGAGGGCCCCAGCTCCCCTTCCGGGAAG

CTCATGAGCCCCAAGCTGTATGTGTGGGCCAAAGACCGCCCTGAGATCTGGGAGGGAGAGCCTCCGTGTCTCCCACCG

AGGGACAGCCTGAACCAGAGCCTCAGCCAGGACCTCACCATGGCCCCTGGCTCCACACTCTGGCTGTCCTGTGGGGTA

CCCCCTGACTCTGTGTCCAGGGGCCCCCTCTCCTGGACCCATGTGCACCCCAAGGGGCCTAAGTCATTGCTGAGCCTA

GAGCTGAAGGACGATCGCCCGGCCAGAGATATGTGGGTAATGGAGACGGGTCTGTTGTTGCCCCGGGCCACAGCTCAA

GACGCTGGAAAGTATTATTGTCACCGTGGCAACCTGACCATGTCATTCCACCTGGAGATCACTGCTCGGCCAGGGGGA

GGTGGGTCTGGAGGTGGAGGATCTGGTGGAGGTGGGTCTGTCAGATCATCTTCTCGAACCCCGAGTGACAAGCCTGTA

GCCCATGTTGTAGCAAACCCTCAAGCTGAGGGGCAGCTCCAGTGGCTGAACCGCCGGGCCAATGCCCTCCTGGCCAAT

GGCGTGGAGCTGAGAGATAACCAGCTGGTGGTGCCATCAGAGGGCCTGTACCTCATCTACTCCCAGGTCCTCTTCAAG

GGCCAAGGCTGCCCCTCCACCCATGTGCTCCTCACCCACACCATCAGCCGCATCGCCGTCTCCTACCAGACCAAGGTC

AACCTCCTCTCTGCCATCAAGAGCCCCTGCCAGAGGGAGACCCCAGAGGGGGCTGAGGCCAAGCCCTGGTATGAGCCC

ATCTATCTGGGAGGGGTCTTCCAGCTGGAGAAGGGTGACCGACTCAGCGCTGAGATCAATCGGCCCGACTATCTCGAC

TTTGCCGAGTCTGGGCAGGTCTACTTTGGGATCATTGCCCTG

SEQ ID NO. 224
ATGGAGTTTGGGCTGAGCTGGGTTTTCCTCGTTGCTCTTTTTAGAGGTGTCCAGTGTGAGGTGCAGCTGGTGGAGTCT

GGTGGTGGTCTTGTTCAACCTGGTGGTTCTCTTCGTCTTTCTTGTGCTGCTTCTGGTTTTAATATTAAAGATACTTAT

ATTCATTGGGTTCGTCAAGCTCCTGGTAAAGGTCTTGAATGGGTTGCTCGTATTTATCCTACTAATGGTTATACTCGT

TATGCTGATTCTGTTAAAGGTCGTTTTACTATTTCTGCTGATACTTCTAAAAATACTGCTTATCTTCAAATGAACTCT

CTTCGTGCTGAAGATACTGCTGTTTATTATTGTTCTCGTTGGGGTGGTGATGGTTTTTATGCTATGGATTATTGGGGT

CAAGGTACTCTTGTCACCGTCTCCTCAGCTAGCACCGGGGGAGGTGGGTCTGGAGGTGGAGGATCTGGTGGAGGTGGG

TCTGACATCCAGATGACCCAGTCTCCTTCTTCTCTTTCTGCTTCTGTTGGTGATCGTGTTACTATTACTTGTCGTGCT

TCTCAAGATGTTAATACTGCTGTTGCTTGGTATCAACAAAAACCTGGTAAAGCTCCTAAACTTCTTATTTATTCTGCT

TCTTTTCTTTATTCTGGTGTTCCTTCTCGTTTTTCTGGTTCTCGTTCTGGTACTGATTTTACTCTTACTATTTCTTCT

CTTCAACCTGAAGATTTTGCTACTTATTATTGTCAACAACATTATACTACTCCTCCTACTTTTGGTCAAGGTACCAAG

GTGGAGATCAAACGTACGGACAAAACTCACACATCGCCACCGTCCCCAGCACCTGAAGCCGCGGGGGGACCGTCAGAA

GTCAGGCCCGAGGAACCTCTAGTGGTGAAGGTGGAAGAGGGAGATAACGCTGTGCTGCAGTGCCTCAAGGGGACCTCA

GATGGCCCCACTCAGCAGCTGACCTGGTCTCGGGAGTCCCCGCTTAAACCCTTCTTAAAACTCAGCCTGGGGCTGCCA

GGCCTGGGAATCCACATGAGGCCCCTGGCCATCTGGCTTTTCATCTTCAACGTCTCTCAACAGATGGGGGGCTTCTAC

CTGTGCCAGCCGGGGCCCCCCTCTGAGAAGGCCTGGCAGCCTGGCTGGACAGTCAATGTGGAGGGCAGCGGGTCTAGA

GGGCCCCATCATCACCATCACCAT

SEQ ID NO. 225
ATGGAGTTTGGGCTGAGCTGGGTTTTCCTCGTTGCTCTTTTTAGAGGTGTCCAGTGTGAGGTGCAGCTGGTGGAGTCT

GGTGGTGGTCTTGTTCAACCTGGTGGTTCTCTTCGTCTTTCTTGTGCTGCTTCTGGTTTTAATATTAAAGATACTTAT

ATTCATTGGGTTCGTCAAGCTCCTGGTAAAGGTCTTGAATGGGTTGCTCGTATTTATCCTACTAATGGTTATACTCGT

-continued

TATGCTGATTCTGTTAAAGGTCGTTTTACTATTTCTGCTGATACTTCTAAAAATACTGCTTATCTTCAAATGAACTCT

CTTCGTGCTGAAGATACTGCTGTTTATTATTGTTCTCGTTGGGGTGGTGATGGTTTTTATGCTATGGATTATTGGGGT

CAAGGTACTCTTGTCACCGTCTCCTCAGCTAGCACCGGGGGAGGTGGGTCTGGAGGTGGAGGATCGGTGGAGGTGGG

TCTGACATCCAGATGACCCAGTCTCCTTCTTCTCTTTCTGCTTCTGTTGGTGATCGTGTTACTATTACTTGTCGTGCT

TCTCAAGATGTTAATACTGCTGTTGCTTGGTATCAACAAAAACCTGGTAAAGCTCCTAAACTTCTTATTTATTCTGCT

TCTTTTCTTTATTCTGGTGTTCCTTCTCGTTTTTCTGGTTCTCGTTCTGGTACTGATTTTACTCTTACTATTTCTTCT

CTTCAACCTGAAGATTTTGCTACTTATTATTGTCAACAACATTATACTACTCCTCCTACTTTTGGTCAAGGTACCAAG

GTGGAGATCAAACGTACGGACAAAACTCACACATCGCCACCGTCCCCAGCACCTGAAGCCGCGGGGGGACCGTCAGAA

GTCAGGCCCGAGGAACCTCTAGTGGTGAAGGTGGAAGAGGGAGATAACGCTGTGCTGCAGTGCCTCAAGGGGACCTCA

GATGGCCCCACTCAGCAGCTGACCTGGTCTCGGGAGTCCCCGCTTAAACCCTTCTTAAAACTCAGCCTGGGGCTGCCA

GGCCTGGGAATCCACATGAGGCCCCTGGCCATCTGGCTTTTCATCTTCAACGTCTCTCAACAGATGGGGGGCTTCTAC

CTGTGCCAGCCGGGGCCCCCCTCTGAGAAGGCCTGGCAGCCTGGCTGGACAGTCAATGTGGAGGGCAGCGGGGACAAA

ACTCACACATGCCCACCGTGCCCAGCACCTGAACTCCTGGGGGGACCGTCAGTCTTCCTCTTCCCCCCAAAACCCAAG

GACACCCTCATGATCTCCCGGACCCCTGAGGTCACATGCGTGGTGGTGGACGTGAGCCACGAAGACCCTGAGGTCAAG

TTCAACTGGTACGTGGACGGCGTGGAGGTGCATAATGCCAAGACAAAGCCGCGGGAGGAGCAGTACAACAGCACGTAC

CGTGTGGTCAGCGTCCTCACCGTCCTGCACCAGGACTGGCTGAATGGCAAGGAGTACAAGTGCAAGGTCTCCAACAAA

GCCCTCCCAGCCCCCATCGAGAAAACCATCTCCAAAGCCAAAGGGCAGCCCCGAGAACCACAGGTGTACACCCTGCCC

CCATCCCGGGAGGAGATGACCAAGAACCAGGTCAGCCTGACCTGCCTGGTCAAAGGCTTCTATCCCAGCGACATCGCC

GTGGAGTGGGAGAGCAATGGGCAGCCGGAGAACAACTACAAGACCACGCCTCCCGTGCTGGACTCCGACGGCTCCTTC

TTCCTCTACAGCAAGCTCACCGTGGACAAGAGCAGGTGGCAGCAGGGGAACGTCTTCTCATGCTCCGTGATGCACGAG

GCTCTGCACAACCACTACACGCAGAAGAGCCTCTCCCTGTCTCCGGGT

SEQ ID NO. 226
ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

GCCATCTGGCTTTTCATCTTCAACGTCTCTCAACAGATGGGGGGCTTCTACCTGTGCCAGCCGGGGCCCCCCTCTGAG

AAGGCCTGGCAGCCTGGCTGGACAGTCAATGTGGAGGGCAGCGGGGGGAGGTGGGTCTGGAGGTGGAGGATCTGGT

GGAGGTGGGTCTGGTGGAGGTGGGTCTGAGGTGCAGCTGGTGGAGTCTGGTGGTGGTCTTGTTCAACCTGGTGGTTCT

CTTCGTCTTTCTTGTGCTGCTTCTGGTTTTAATATTAAAGATACTTATATTCATTGGGTTCGTCAAGCTCCTGGTAAA

GGTCTTGAATGGGTTGCTCGTATTTATCCTACTAATGGTTATACTCGTTATGCTGATTCTGTTAAAGGTCGTTTTACT

ATTTCTGCTGATACTTCTAAAAATACTGCTTATCTTCAAATGAACTCTCTTCGTGCTGAAGATACTGCTGTTTATTAT

TGTTCTCGTTGGGGTGGTGATGGTTTTTATGCTATGGATTATTGGGGTCAAGGTACTCTTGTCACCGTCTCCTCAGCT

AGCACCGGGGGAGGTGGGTCTGGAGGTGGAGGATCGGTGGAGGTGGGTCTGACATCCAGATGACCCAGTCTCCTTCT

TCTCTTTCTGCTTCTGTTGGTGATCGTGTTACTATTACTTGTCGTGCTTCTCAAGATGTTAATACTGCTGTTGCTTGG

TATCAACAAAAACCTGGTAAAGCTCCTAAACTTCTTATTTATTCTGCTTCTTTTCTTTATTCTGGTGTTCCTTCTCGT

TTTTCTGGTTCTCGTTCTGGTACTGATTTTACTCTTACTATTTCTTCTCTTCAACCTGAAGATTTTGCTACTTATTAT

TGTCAACAACATTATACTACTCCTCCTACTTTTGGTCAAGGTACCAAGGTGGAGATCAAACGTACGTCTAGAGGGCCC

CATCATCACCATCACCAT

SEQ ID NO. 227
ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

-continued

```
GCCATCTGGCTTTTCATCTTCAACGTCTCTCAACAGATGGGGGCTTCTACCTGTGCCAGCCGGGGCCCCCCTCTGAG

AAGGCCTGGCAGCCTGGCTGGACAGTCAATGTGGAGGGCAGCGGGGGGGAGGTGGGTCTGGAGGTGGAGGATCTGGT

GGAGGTGGGTCTGGTGGAGGTGGGTCTGAGGTGCAGCTGGTGGAGTCTGGTGGTGGTCTTGTTCAACCTGGTGGTTCT

CTTCGTCTTTCTTGTGCTGCTTCTGGTTTTAATATTAAAGATACTTATATTCATTGGGTTCGTCAAGCTCCTGGTAAA

GGTCTTGAATGGGTTGCTCGTATTTATCCTACTAATGGTTATACTCGTTATGCTGATTCTGTTAAAGGTCGTTTTACT

ATTTCTGCTGATACTTCTAAAAATACTGCTTATCTTCAAATGAACTCTCTTCGTGCTGAAGATACTGCTGTTTATTAT

TGTTCTCGTTGGGGTGGTGATGGTTTTTATGCTATGGATTATTGGGGTCAAGGTACTCTTGTCACCGTCTCCTCAGCT

AGCACCGGGGGAGGTGGGTCTGGAGGTGGAGGATCTGGTGGAGGTGGGTCTGACATCCAGATGACCCAGTCTCCTTCT

TCTCTTTCTGCTTCTGTTGGTGATCGTGTTACTATTACTTGTCGTGCTTCTCAAGATGTTAATACTGCTGTTGCTTGG

TATCAACAAAAACCTGGTAAAGCTCCTAAACTTCTTATTTATTCTGCTTCTTTTCTTTATTCTGGTGTTCCTTCTCGT

TTTTCTGGTTCTCGTTCTGGTACTGATTTTACTCTTACTATTTCTTCTCTTCAACCTGAAGATTTTGCTACTTATTAT

TGTCAACAACATTATACTACTCCTCCTACTTTTGGTCAAGGTACCAAGGTGGAGATCAAACGTACGGACAAAACTCAC

ACATGCCCACCGTGCCCAGCACCTGAACTCCTGGGGGGACCGTCAGTCTTCCTCTTCCCCCCAAAACCCAAGGACACC

CTCATGATCTCCCGGACCCCTGAGGTCACATGCGTGGTGGTGGACGTGAGCCACGAAGACCCTGAGGTCAAGTTCAAC

TGGTACGTGGACGGCGTGGAGGTGCATAATGCCAAGACAAAGCCGCGGGAGGAGCAGTACAACAGCACGTACCGTGTG

GTCAGCGTCCTCACCGTCCTGCACCAGGACTGGCTGAATGGCAAGGAGTACAAGTGCAAGGTCTCCAACAAAGCCCTC

CCAGCCCCCATCGAGAAAACCATCTCCAAAGCCAAAGGGCAGCCCCGAGAACCACAGGTGTACACCCTGCCCCCATCC

CGGGAGGAGATGACCAAGAACCAGGTCAGCCTGACCTGCCTGGTCAAAGGCTTCTATCCCAGCGACATCGCCGTGGAG

TGGGAGAGCAATGGGCAGCCGGAGAACAACTACAAGACCACGCCTCCCGTGCTGGACTCCGACGGCTCCTTCTTCCTC

TACAGCAAGCTCACCGTGGACAAGAGCAGGTGGCAGCAGGGGAACGTCTTCTCATGCTCCGTGATGCACGAGGCTCTG

CACAACCACTACACGCAGAAGAGCCTCTCCCTGTCTCCGGGT
```

SEQ ID NO. 228
```
ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

GCCATCTGGCTTTTCATCTTCAACGTCTCTCAACAGATGGGGGCTTCTACCTGTGCCAGCCGGGGCCCCCCTCTGAG

AAGGCCTGGCAGCCTGGCTGGACAGTCAATGTGGAGGGCAGCGGGGAGCTGTTCCGGTGGAATGTTTCGGACCTAGGT

GGCCTGGGCTGTGGCCTGAAGAACAGGTCCTCAGAGGGCCCCAGCTCCCCTTCCGGGAAGCTCATGAGCCCCAAGCTG

TATGTGTGGGCCAAAGACCGCCCTGAGATCTGGGAGGGAGAGCCTCCGTGTCTCCCACCGAGGGACAGCCTGAACCAG

AGCCTCAGCCAGGACCTCACCATGGCCCCTGGCTCCACACTCTGGCTGTCCTGTGGGGTACCCCCTGACTCTGTGTCC

AGGGGCCCCCTCTCCTGGACCCATGTGCACCCCAAGGGGCCTAAGTCATTGCTGAGCCTAGAGCTGAAGGACGATCGC

CCGGCCAGAGATATGTGGGTAATGGAGACGGGTCTGTTGTTGCCCCGGGCCACAGCTCAAGACGCTGGAAAGTATTAT

TGTCACCGTGGCAACCTGACCATGTCATTCCACCTGGAGATCACTGCTCGGCCACATCATCACCATCACCAT
```

SEQ ID NO. 229
```
ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

GCCATCTGGCTTTTCATCTTCAACGTCTCTCAACAGATGGGGGCTTCTACCTGTGCCAGCCGGGGCCCCCCTCTGAG

AAGGCCTGGCAGCCTGGCTGGACAGTCAATGTGGAGGGCAGCGGGGAGCTGTTCCGGTGGAATGTTTCGGACCTAGGT

GGCCTGGGCTGTGGCCTGAAGAACAGGTCCTCAGAGGGCCCCAGCTCCCCTTCCGGGAAGCTCATGAGCCCCAAGCTG

TATGTGTGGGCCAAAGACCGCCCTGAGATCTGGGAGGGAGAGCCTCCGTGTCTCCCACCGAGGGACAGCCTGAACCAG
```

-continued

AGCCTCAGCCAGGACCTCACCATGGCCCCTGGCTCCACACTCTGGCTGTCCTGTGGGGTACCCCCTGACTCTGTGTCC

AGGGGCCCCCTCTCCTGGACCCATGTGCACCCCAAGGGGCCTAAGTCATTGCTGAGCCTAGAGCTGAAGGACGATCGC

CCGGCCAGAGATATGTGGGTAATGGAGACGGGTCTGTTGTTGCCCCGGGCCACAGCTCAAGACGCTGGAAAGTATTAT

TGTCACCGTGGCAACCTGACCATGTCATTCCACCTGGAGATCACTGCTCGGCCAGACAAAACTCACACATGCCCACCG

TGCCCAGCACCTGAACTCCTGGGGGGACCGTCAGTCTTCCTCTTCCCCCCAAAACCCAAGGACACCCTCATGATCTCC

CGGACCCCTGAGGTCACATGCGTGGTGGTGGACGTGAGCCACGAAGACCCTGAGGTCAAGTTCAACTGGTACGTGGAC

GGCGTGGAGGTGCATAATGCCAAGACAAAGCCGCGGGAGGAGCAGTACAACAGCACGTACCGTGTGGTCAGCGTCCTC

ACCGTCCTGCACCAGGACTGGCTGAATGGCAAGGAGTACAAGTGCAAGGTCTCCAACAAAGCCCTCCCAGCCCCCATC

GAGAAAACCATCTCCAAAGCCAAAGGGCAGCCCCGAGAACCACAGGTGTACACCCTGCCCCCATCCCGGGAGGAGATG

ACCAAGAACCAGGTCAGCCTGACCTGCCTGGTCAAAGGCTTCTATCCCAGCGACATCGCCGTGGAGTGGGAGAGCAAT

GGGCAGCCGGAGAACAACTACAAGACCACGCCTCCCGTGCTGGACTCCGACGGCTCCTTCTTCCTCTACAGCAAGCTC

ACCGTGGACAAGAGCAGGTGGCAGCAGGGGAACGTCTTCTCATGCTCCGTGATGCACGAGGCTCTGCACAACCACTAC

ACGCAGAAGAGCCTCTCCCTGTCTCCGGGT

SEQ ID NO. 230
ATGCCACCTCCTCGCCTCCTCTTCTTCCTCCTCTTCCTCACCCCCATGGAAGTCAGGCCGAGGGACAGCCTGAACCAG

AGCCTCAGCCAGGACCTCACCATGGCCCCTGGCTCCACACTCTGGCTGTCCTGTGGGGTACCCCCTGACTCTGTGTCC

AGGGGCCCCCTCTCCTGGACCCATGTGCACCCCAAGGGGCCTAAGTCATTGCTGAGCCTAGAGCTGAAGGACGATCGC

CCGGCCAGAGATATGTGGGTAATGGAGACGGGTCTGTTGTTGCCCCGGGCCACAGCTCAAGACGCTGGAAAGTATTAT

TGTCACCGTGGCAACCTGACCATGTCATTCCACCTGGAGATCACTGCTCGGCCACATCATCACCATCACCAT

SEQ ID NO. 231
ATGCCACCTCCTCGCCTCCTCTTCTTCCTCCTCTTCCTCACCCCCATGGAAGTCAGGCCGAGGGACAGCCTGAACCAG

AGCCTCAGCCAGGACCTCACCATGGCCCCTGGCTCCACACTCTGGCTGTCCTGTGGGGTACCCCCTGACTCTGTGTCC

AGGGGCCCCCTCTCCTGGACCCATGTGCACCCCAAGGGGCCTAAGTCATTGCTGAGCCTAGAGCTGAAGGACGATCGC

CCGGCCAGAGATATGTGGGTAATGGAGACGGGTCTGTTGTTGCCCCGGGCCACAGCTCAAGACGCTGGAAAGTATTAT

TGTCACCGTGGCAACCTGACCATGTCATTCCACCTGGAGATCACTGCTCGGCCAGACAAAACTCACACATGCCCACCG

TGCCCAGCACCTGAACTCCTGGGGGGACCGTCAGTCTTCCTCTTCCCCCCAAAACCCAAGGACACCCTCATGATCTCC

CGGACCCCTGAGGTCACATGCGTGGTGGTGGACGTGAGCCACGAAGACCCTGAGGTCAAGTTCAACTGGTACGTGGAC

GGCGTGGAGGTGCATAATGCCAAGACAAAGCCGCGGGAGGAGCAGTACAACAGCACGTACCGTGTGGTCAGCGTCCTC

ACCGTCCTGCACCAGGACTGGCTGAATGGCAAGGAGTACAAGTGCAAGGTCTCCAACAAAGCCCTCCCAGCCCCCATC

GAGAAAACCATCTCCAAAGCCAAAGGGCAGCCCCGAGAACCACAGGTGTACACCCTGCCCCCATCCCGGGAGGAGATG

ACCAAGAACCAGGTCAGCCTGACCTGCCTGGTCAAAGGCTTCTATCCCAGCGACATCGCCGTGGAGTGGGAGAGCAAT

GGGCAGCCGGAGAACAACTACAAGACCACGCCTCCCGTGCTGGACTCCGACGGCTCCTTCTTCCTCTACAGCAAGCTC

ACCGTGGACAAGAGCAGGTGGCAGCAGGGGAACGTCTTCTCATGCTCCGTGATGCACGAGGCTCTGCACAACCACTAC

ACGCAGAAGAGCCTCTCCCTGTCTCCGGGT

SEQ ID NO. 232
ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAAACTCAGCCTGGGGCTGCCAGGCCTGGGAATCCACATGAGGCCCCTG

GCCATCTGGCTTTTCATCTTCAACGTCTCTCAACAGATGGGGGCTTCTACCTGTGCCAGCCGGGGCCCCCCTCTGAG

AAGGCCTGGCAGCCTGGCTGGACAGTCAATGTGGAGGGCAGCGGGGAGCTGTTCCGGTGGAATGTTTCGGACCTAGGT

GGCCTGGGCTGTGGCCTGAAGAACAGGTCCTCAGAGGGCCCCAGCTCCCCTTCCGGGAAGCTCATGAGCCCCAAGCTG

TATGTGTGGGCCAAAGACCGCCCTGAGATCTGGGAGGGAGAGCCTCCGTGTCTCCCACCGAGGGACAGCCTGAACCAG

-continued

AGCCTCAGCCAGGACCTCACCATGGCCCCTGGCTCCACACTCTGGCTGTCCTGTGGGGTACCCCCTGACTCTGTGTCC
AGGGGCCCCTCTCCTGGACCCATGTGCACCCCAAGGGGCCTAAGTCATTGCTGAGCCTAGAGCTGAAGGACGATCGC
CCGGCCAGAGATATGTGGGTAATGGAGACGGGTCTGTTGTTGCCCCGGGCCACAGCTCAAGACGCTGGAAAGTATTAT
TGTCACCGTGGCAACCTGACCATGTCATTCCACCTGGAGATCACTGCTCGGCCAGGAGGAGGTGGGTCTGGAGGTGGA
GGATCTGGTGGAGGTGGGTCTGACATCCAGATGACCCAGTCTCCATCCTCCCTGTCTGCATCTGTAGGAGACAGAGTC
ACCATCACTTGCCAGGCGAGTCAGGACATCAGCAACTATTTAAATTGGTATCAGCAGAAACCAGGGAAAGCCCCTAAA
CTCCTGATCTACGATGCATCCAATTTGGAAACAGGGGTCCCATCAAGGTTCAGTGGAAGTGGATCTGGGACAGATTTT
ACTTTCACCATCAGCAGCCTGCAGCCTGAAGATATTGCAACATATTTCTGTCAACACTTTGATCATCTCCCGCTCGCT
TTCGGCGGAGGGACCAAGGTGGAGATCAAACGAACTGTGGCTGCACCATCTGTCTTCATCTTCCCGCCATCTGATGAG
CAGTTGAAATCTGGAACTGCCTCTGTTGTGTGCCTGCTGAATAACTTCTATCCCAGAGAGGCCAAAGTACAGTGGAAG
GTGGATAACGCCCTCCAATCGGGTAACTCCCAGGAGAGTGTCACAGAGCAGGACAGCAAGGACAGCACCTACAGCCTC
AGCAGCACCCTGACGCTGAGCAAAGCAGACTACGAGAAACACAAAGTCTACGCCTGCGAAGTCACCCATCAGGGCCTG
AGCTCGCCCGTCACAAAGAGCTTCAACAGGGGAGAGTGT

SEQ ID NO. 233
ATGCCACCTCCTCGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCAGCAGCTGACCTGG
TCTCGGGAGTCCCCGCTTAAACCCTTCTTAAAAACTCAGCCTGGGGCTGCCAGGCCTGGGAATCCACATGAGGCCCCTG
GCCATCTGGCTTTTCATCTTCAACGTCTCTCAACAGATGGGGGCTTCTACCTGTGCCAGCCGGGGCCCCCCTCTGAG
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGACAGCCTGAACCAG
AGCCTCAGCCAGGACCTCACCATGGCCCCTGGCTCCACACTCTGGCTGTCCTGTGGGGTACCCCCTGACTCTGTGTCC
AGGGGCCCCTCTCCTGGACCCATGTGCACCCCAAGGGGCCTAAGTCATTGCTGAGCCTAGAGCTGAAGGACGATCGC
CCGGCCAGAGATATGTGGGTAATGGAGACGGGTCTGTTGTTGCCCCGGGCCACAGCTCAAGACGCTGGAAAGTATTAT
TGTCACCGTGGCAACCTGACCATGTCATTCCACCTGGAGATCACTGCTCGGCCAGGAGGAGGTGGGTCTGGAGGTGGA
GGATCTGGTGGAGGTGGGTCTCAGGTGCAGCTGCAGGAGTCGGGCCCAGGACTGGTGAAGCCTTCGGAGACCCTGTCC
CTCACCTGCACTGTCTCTGGTGGCTCCGTCAGCAGTGGTGATTACTACTGGACCTGGATCCGGCAGTCCCCAGGGAAG
GGACTGGAGTGGATTGGACACATCTATTACAGTGGGAACACCAATTATAACCCCTCCCTCAAGAGTCGACTCACCATA
TCAATTGACACGTCCAAGACTCAGTTCTCCCTGAAGCTGAGTTCTGTGACCGCTGCGGACACGGCCATTTATTACTGT
GTGCGAGATCGAGTGACTGGTGCTTTTGATATCTGGGGCCAAGGGACAATGGTCACCGTCTCTTCAGCCTCCACCAAG
GGCCCATCGGTCTTCCCCCTGGCGCCCTGCTCCAGGAGCACCTCCGAGAGCACAGCGGCCCTGGGCTGCCTGGTCAAG
GACTACTTCCCTGAACCGGTGACGGTGTCGTGGAACTCAGGCGCTCTGACCAGCGGCGTGCACACCTTCCCGGCTGTC
CTACAGTCCTCAGGACTCTACTCCCTCAGCAGCGTGGTGACCGTGCCCTCCAGCAACTTCGGCACCCAGACCTACACC
TGCAACGTAGATCACAAGCCCAGCAATACCAAGGTGGACAAGACAGTTGAGCGCAAATGTTGTGTCGAGTGCCCACCG
TGCCCAGCACCACCTGTGGCAGGACCGTCAGTCTTCCTCTTCCCCCCAAAACCCAAGGACACCCTCATGATCTCCCGG
ACCCCTGAGGTCACGTGCGTGGTGGTGGACGTGAGCCACGAAGACCCCGAGGTCCAGTTCAACTGGTACGTGGACGGC
GTGGAGGTGCATAATGCCAAGACAAAGCCACGGGAGGAGCAGTTCCAAAGCACGTTCCGTGTGGTCAGCGTCCTCACC
GTCGTGCACCAGGACTGGCTGAACGGCAAGGAGTACAAGTGCAAGGTCTCCAACAAAGGCCTCCCAGCCCCCATCGAG
AAAACCATCTCCAAAACCAAAGGGCAGCCCCGAGAACCACAGGTGTACACCCTGCCCCCATCCCGGGAGGAGATGACC
AAGAACCAGGTCAGCCTGACCTGCCTGGTCAAAGGCTTCTACCCCAGCGACATCGCCGTGGAGTGGGAGAGCAATGGG
CAGCCGGAGAACAACTACAAGACCACGCCTCCCATGCTGGACTCCGACGGCTCCTTCTTCCTCTACAGCAAGCTCACC

-continued

GTGGACAAGAGCAGGTGGCAGCAGGGGAACGTCTTCTCATGCTCCGTGATGCATGAGGCTCTGCACAACCACTACACG

CAGAAGAGCCTCTCCCTGTCTCCGGGT

SEQ ID NO. 234

ATGGAGACAGACACACTCCTGCTATGGGTACTGCTGCTCTGGGTTCCAGGTTCCACTGGTGACATCCAGATGACCCAG

TCTCCATCCTCCCTGTCTGCATCTGTAGGAGACAGAGTCACCATCACTTGCCAGGCGAGTCAGGACATCAGCAACTAT

TTAAATTGGTATCAGCAGAAACCAGGGAAAGCCCCTAAACTCCTGATCTACGATGCATCCAATTTGGAAACAGGGGTC

CCATCAAGGTTCAGTGGAAGTGGATCTGGGACAGATTTTACTTTCACCATCAGCAGCCTGCAGCCTGAAGATATTGCA

ACATATTTCTGTCAACACTTTGATCATCTCCCGCTCGCTTTCGGCGGAGGGACCAAGGTGGAGATCAAACGAACTGTG

GCTGCACCATCTGTCTTCATCTTCCCGCCATCTGATGAGCAGTTGAAATCTGGAACTGCCTCTGTTGTGTGCCTGCTG

AATAACTTCTATCCCAGAGAGGCCAAAGTACAGTGGAAGGTGGATAACGCCCTCCAATCGGGTAACTCCCAGGAGAGT

GTCACAGAGCAGGACAGCAAGGACAGCACCTACAGCCTCAGCAGCACCCTGACGCTGAGCAAAGCAGACTACGAGAAA

CACAAAGTCTACGCCTGCGAAGTCACCCATCAGGGCCTGAGCTCGCCCGTCACAAAGAGCTTCAACAGGGGAGAGTGT

GACAAAACTCACACATCGCCACCGTCCCCAGCACCTGAAGCGCGGGGGGACCGTCACCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

GCCATCTGGCTTTTCATCTTCAACGTCTCTCAACAGATGGGGGGCTTCTACCTGTGCCAGCCGGGGCCCCCCTCTGAG

AAGGCCTGGCAGCCTGGCTGGACAGTCAATGTGGAGGGCAGCGGGGAGCTGTTCCGGTGGAATGTTTCGGACCTAGGT

GGCCTGGGCTGTGGCCTGAAGAACAGGTCCTCAGAGGGCCCCAGCTCCCCTTCCGGGAAGCTCATGAGCCCCAAGCTG

TATGTGTGGGCCAAAGACCGCCCTGAGATCTGGGAGGGAGAGCCTCCGTGTCTCCCACCGAGGGACAGCCTGAACCAG

AGCCTCAGCCAGGACCTCACCATGGCCCCTGGCTCCACACTCTGGCTGTCCTGTGGGGTACCCCTGACTCTGTGTCC

AGGGGCCCCCTCTCCTGGACCCATGTGCACCCCAAGGGGCCTAAGTCATTGCTGAGCCTAGAGCTGAAGGACGATCGC

CCGGCCAGAGATATGTGGGTAATGGAGACGGGTCTGTTGTTGCCCCGGGCCACAGCTCAAGACGCTGGAAAGTATTAT

TGTCACCGTGGCAACCTGACCATGTCATTCCACCTGGAGATCACTGCTCGGCCA

SEQ ID NO. 235

ATGGAGTTTGGGCTGAGCTGGGTTTTCCTCGTTGCTCTTTTTAGAGGTGTCCAGTGTCAGGTGCAGCTGCAGGAGTCG

GGCCCAGGACTGGTGAAGCCTTCGGAGACCCTGTCCCTCACCTGCACTGTCTCTGGTGGCTCCGTCAGCAGTGGTGAT

TACTACTGGACCTGGATCCGGCAGTCCCCAGGGAAGGGACTGGAGTGGATTGGACACATCTATTACAGTGGGAACACC

AATTATAACCCCTCCCTCAAGAGTCGACTCACCATATCAATTGACACGTCCAAGACTCAGTTCTCCCTGAAGCTGAGT

TCTGTGACCGCTGCGGACACGGCCATTTATTACTGTGTGCGAGATCGAGTGACTGGTGCTTTTGATATCTGGGGCCAA

GGGACAATGGTCACCGTCTCTTCAGCCTCCACCAAGGGCCCATCGGTCTTCCCCCTGGCGCCCTGCTCCAGGAGCACC

TCCGAGAGCACAGCGGCCCTGGGCTGCCTGGTCAAGGACTACTTCCCTGAACCGGTGACGGTGTCGTGGAACTCAGGC

GCTCTGACCAGCGGCGTGCACACCTTCCCGGCTGTCCTACAGTCCTCAGGACTCTACTCCCTCAGCAGCGTGGTGACC

GTGCCCTCCAGCAACTTCGGCACCCAGACCTACACCTGCAACGTAGATCACAAGCCCAGCAATACCAAGGTGGACAAG

ACAGTTGAGCGCAAATGTTGTGTCGAGTGCCCACCGTGCCCAGCACCACCTGTGGCAGGACCGTCAGTCTTCCTCTTC

CCCCCAAAACCCAAGGACACCCTCATGATCTCCCGGACCCCTGAGGTCACGTGCGTGGTGGTGGACGTGAGCCACGAA

GACCCCGAGGTCCAGTTCAACTGGTACGTGGACGGCGTGGAGGTGCATAATGCCAAGACAAAGCCACGGGAGGAGCAG

TTCCAAAGCACGTTCCGTGTGGTCAGCGTCCTCACCGTCGTGCACCAGGACTGGCTGAACGGCAAGGAGTACAAGTGC

AAGGTCTCCAACAAAGGCCTCCCAGCCCCCATCGAGAAAACCATCTCCAAAACCAAAGGGCAGCCCCGAGAACCACAG

GTGTACACCCTGCCCCCATCCCGGGAGGAGATGACCAAGAACCAGGTCAGCCTGACCTGCCTGGTCAAAGGCTTCTAC

CCCAGCGACATCGCCGTGGAGTGGGAGAGCAATGGGCAGCCGGAGAACAACTACAAGACCACGCCTCCCATGCTGGAC

TCCGACGGCTCCTTCTTCCTCTACAGCAAGCTCACCGTGGACAAGAGCAGGTGGCAGCAGGGGAACGTCTTCTCATGC

TCCGTGATGCATGAGGCTCTGCACAACCACTACACGCAGAAGAGCCTCTCCCTGTCTCCGGGTGGTGGAGGTGGGTCT

```
GGAGGTGGAGGATCTGGTGGAGGTGGGTCTCCCGAGGAACCTCTAGTGGTGAAGGTGGAAGAGGGAGATAACGCTGTG
CTGCAGTGCCTCAAGGGGACCTCAGATGGCCCCACTCAGCAGCTGACCTGGTCTCGGGAGTCCCCGCTTAAACCCTTC
TTAAAACTCAGCCTGGGGCTGCCAGGCCTGGGAATCCACATGAGGCCCCTGGCCATCTGGCTTTTCATCTTCAACGTC
TCTCAACAGATGGGGGGCTTCTACCTGTGCCAGCCGGGGCCCCCCTCTGAGAAGGCCTGGCAGCCTGGCTGGACAGTC
AATGTGGAGGGCAGCGGGGAGCTGTTCCGGTGGAATGTTTCGGACCTAGGTGGCCTGGGCTGTGGCCTGAAGAACAGG
TCCTCAGAGGGCCCCAGCTCCCCTTCCGGGAAGCTCATGAGCCCCAAGCTGTATGTGTGGGCCAAAGACCGCCCTGAG
ATCTGGGAGGGAGAGCCTCCGTGTCTCCCACCGAGGGACAGCCTGAACCAGAGCCTCAGCCAGGACCTCACCATGGCC
CCTGGCTCCACACTCTGGCTGTCCTGTGGGGTACCCCCTGACTCTGTGTCCAGGGGCCCCCTCTCCTGGACCCATGTG
CACCCCAAGGGGCCTAAGTCATTGCTGAGCCTAGAGCTGAAGGACGATCGCCCGGCCAGAGATATGTGGGTAATGGAG
ACGGGTCTGTTGTTGCCCCGGGCCACAGCTCAAGACGCTGGAAAGTATTATTGTCACCGTGGCAACCTGACCATGTCA
TTCCACCTGGAGATCACTGCTCGGCCA
                                                              SEQ ID NO. 236
ATGCCACCTCCTCGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCAGCAGCTGACCTGG
TCTCGGGAGTCCCCGCTTAAACCCTTCTTAAAACTCAGCCTGGGGCTGCCAGGCCTGGGAATCCACATGAGGCCCCTG
GCCATCTGGCTTTTCATCTTCAACGTCTCTCAACAGATGGGGGGCTTCTACCTGTGCCAGCCGGGGCCCCCCTCTGAG
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGACAGCCTGAACCAG
AGCCTCAGCCAGGACCTCACCATGGCCCCTGGCTCCACACTCTGGCTGTCCTGTGGGGTACCCCCTGACTCTGTGTCC
AGGGGCCCCCTCTCCTGGACCCATGTGCACCCCAAGGGGCCTAAGTCATTGCTGAGCCTAGAGCTGAAGGACGATCGC
CCGGCCAGAGATATGTGGGTAATGGAGACGGGTCTGTTGTTGCCCCGGGCCACAGCTCAAGACGCTGGAAAGTATTAT
TGTCACCGTGGCAACCTGACCATGTCATTCCACCTGGAGATCACTGCTCGGCCAGGAGGAGGTGGGTCTGGAGGTGGA
GGATCTGGTGGAGGTGGGTCTGACATCCAGATGACCCAGTCTCCATCCTCCCTGTCTGCATCTGTAGGAGACAGAGTC
ACCATCACTTGCAGTGTCAGCTCAAGTGTATCCTCCATTTACTTGCACTGGTATCAGCAGAAACCAGGGAAAGCCCCT
AAGCTCCTGATCTATAGCACATCCAACTTGGCTTCTGGAGTCCCATCAAGGTTCAGTGGCAGTGGATCTGGGACAGAT
TTCACTCTCACCATCAGCAGTCTGCAACCTGAAGATTTTGCAACTTACTACTGTCAAGTCTACAGTGGTTACCCGCTC
ACGTTCGGCGGAGGGACCAAGGTGGAGATCAAACGAACTGTGGCTGCACCATCTGTCTTCATCTTCCCGCCATCTGAT
GAGCAGTTGAAATCTGGAACTGCCTCTGTTGTGTGCCTGCTGAATAACTTCTATCCCAGAGAGGCCAAAGTACAGTGG
AAGGTGGATAACGCCCTCCAATCGGGTAACTCCCAGGAGAGTGTCACAGAGCAGGACAGCAAGGACAGCACCTACAGC
CTCAGCAGCACCCTGACGCTGAGCAAAGCAGACTACGAGAAACACAAAGTCTACGCCTGCGAAGTCACCCATCAGGGC
CTGAGCTCGCCCGTCACAAAGAGCTTCAACAGGGGAGAGTGCT
                                                              SEQ ID NO. 237
ATGCCACCTCCTCGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCAGCAGCTGACCTGG
TCTCGGGAGTCCCCGCTTAAACCCTTCTTAAAACTCAGCCTGGGGCTGCCAGGCCTGGGAATCCACATGAGGCCCCTG
GCCATCTGGCTTTTCATCTTCAACGTCTCTCAACAGATGGGGGGCTTCTACCTGTGCCAGCCGGGGCCCCCCTCTGAG
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGACAGCCTGAACCAG
AGCCTCAGCCAGGACCTCACCATGGCCCCTGGCTCCACACTCTGGCTGTCCTGTGGGGTACCCCCTGACTCTGTGTCC
```

-continued

AGGGGCCCCCTCTCCTGGACCCATGTGCACCCCAAGGGGCCTAAGTCATTGCTGAGCCTAGAGCTGAAGGACGATCGC

CCGGCCAGAGATATGTGGGTAATGGAGACGGGTCTGTTGTTGCCCCGGGCCACAGCTCAAGACGCTGGAAAGTATTAT

TGTCACCGTGGCAACCTGACCATGTCATTCCACCTGGAGATCACTGCTCGGCCAGGAGGAGGTGGGTCTGGAGGTGGA

GGATCTGGTGGAGGTGGGTCTCAGGTTCAGCTGGTGCAGTCTGGTGCTGAGGTGAAGAAGCCTGGTGCCTCAGTGAAG

GTCTCCTGCAAGGCTTCTGGTTACACATTCACTGACTACTACATGCACTGGGTGCGTCAGGCCCCTGGTCAAGGTCTT

GAGTGGATGGGTCGTGTTAATCCTAACCGGAGGGGTACTACCTACAACCAGAAATTCGAGGGCCGTGTCACCATGACC

ACAGACACATCCACGAGCACAGCCTACATGGAGCTGCGTAGCCTGCGTTCTGACGACACGGCCGTGTATTACTGTGCG

CGTGCGAACTGGCTTGACTACTGGGGCCAGGGCACCACCGTCACCGTCTCCTCCGCCTCCACCAAGGGCCCATCGGTC

TTCCCGCTAGCGCCCTGCTCCAGGAGCACCTCCGAGAGCACAGCCGCCCTGGGCTGCCTGGTCAAGGACTACTTCCCC

GAACCGGTGACGGTGTCGTGGAACTCAGGCGCCCTGACCAGCGGCGTGCACACCTTCCCGGCTGTCCTACAGTCCTCA

GGACTCTACTCCCTCAGCAGCGTGGTGACCGTGCCCTCCAGCAGCTTGGGCACGAAGACCTACACCTGCAACGTAGAT

CACAAGCCCAGCAACACCAAGGTGGACAAGAGAGTTGAGTCCAAATATGGTCCCCCATGCCCACCCTGCCCAGCACCT

GAGGCCGCCGGGGGACCATCAGTCTTCCTGTTCCCCCCAAAACCCAAGGACACTCTCATGATCTCCCGGACCCCTGAG

GTCACGTGCGTGGTGGTGGACGTGAGCCAGGAAGACCCCGAGGTCCAGTTCAACTGGTACGTGGATGGCGTGGAGGTG

CATAATGCCAAGACAAAGCCGCGGGAGGAGCAGTTCAACAGCACGTACCGTGTGGTCAGCGTCCTCACCGTCCTGCAC

CAGGACTGGCTGAACGGCAAGGAGTACAAGTGCAAGGTCTCCAACAAAGGCCTCCCGTCCTCCATCGAGAAAACCATC

TCCAAAGCCAAAGGGCAGCCCCGAGAGCCACAGGTGTACACCCTGCCCCCATCCCAGGAGGAGATGACCAAGAACCAG

GTCAGCCTGACCTGCCTGGTCAAAGGCTTCTACCCCAGCGACATCGCCGTGGAGTGGGAAAGCAATGGGCAGCCGGAG

AACAACTACAAGACCACGCCTCCCGTGCTGGACTCCGACGGCTCCTTCTTCCTCTACAGCAGGCTAACCGTGGACAAG

AGCAGGTGGCAGGAGGGGAATGTCTTCTCATGCTCCGTGATGCATGAGG

CTCTGCACAACCACTACACACAGAAGAGCCTCTCCCTGTCTCTG

SEQ ID NO. 238
ATGGAGACAGACACACTCCTGCTATGGGTACTGCTGCTCTGGGTTCCAGGTTCCACTGGTGACATCCAGATGACCCAG

TCTCCATCCTCCCTGTCTGCATCTGTAGGAGACAGAGTCACCATCACTTGCAGTGTCAGCTCAAGTGTATCCTCCATT

TACTTGCACTGGTATCAGCAGAAACCAGGGAAAGCCCCTAAGCTCCTGATCTATAGCACATCCAACTTGGCTTCTGGA

GTCCCATCAAGGTTCAGTGGCAGTGGATCTGGGACAGATTTCACTCTCACCATCAGCAGTCTGCAACCTGAAGATTTT

GCAACTTACTACTGTCAAGTCTACAGTGGTTACCCGCTCACGTTCGGCGGAGGGACCAAGGTGGAGATCAAACGAACT

GTGGCTGCACCATCTGTCTTCATCTTCCCGCCATCTGATGAGCAGTTGAAATCTGGAACTGCCTCTGTTGTGTGCCTG

CTGAATAACTTCTATCCCAGAGAGGCCAAAGTACAGTGGAAGGTGGATAACGCCCTCCAATCGGGTAACTCCCAGGAG

AGTGTCACAGAGCAGGACAGCAAGGACAGCACCTACAGCCTCAGCAGCACCCTGACGCTGAGCAAAGCAGACTACGAG

AAACACAAAGTCTACGCCTGCGAAGTCACCCATCAGGGCCTGAGCTCGCCCGTCACAAAGAGCTTCAACAGGGGAGAG

TGCGACAAAACTCACACATCGCCACCGTCCCCAGCACCTGAAGCCGCGGGGGACCGTCACCCGAGGAACCTCTAGTG

GTGAAGGTGGAAGAGGGAGATAACGCTGTGCTGCAGTGCCTCAAGGGGACCTCAGATGGCCCCACTCAGCAGCTGACC

TGGTCTCGGGAGTCCCCGCTTAAACCCTTCTTAAAACTCAGCCTGGGGCTGCCAGGCCTGGGAATCCACATGAGGCCC

CTGGCCATCTGGCTTTTCATCTTCAACGTCTCTCAACAGATGGGGGGCTTCTACCTGTGCCAGCCGGGGCCCCCCTCT

GAGAAGGCCTGGCAGCCTGGCTGGACAGTCAATGTGGAGGGCAGCGGGGAGCTGTTCCGGTGGAATGTTTCGGACCTA

GGTGGCCTGGGCTGTGGCCTGAAGAACAGGTCCTCAGAGGGCCCCAGCTCCCCTTCCGGGAAGCTCATGAGCCCCAAG

CTGTATGTGTGGGCCAAAGACCGCCCTGAGATCTGGGAGGGAGAGCCTCCGTGTCTCCCACCGAGGGACAGCCTGAAC

CAGAGCCTCAGCCAGGACCTCACCATGGCCCCTGGCTCCACACTCTGGCTGTCCTGTGGGGTACCCCCTGACTCTGTG

TCCAGGGGCCCCCTCTCCTGGACCCATGTGCACCCCAAGGGGCCTAAGTCATTGCTGAGCCTAGAGCTGAAGGACGAT

-continued

CGCCCGGCCAGAGATATGTGGGTAATGGAGACGGGTCTGTTGTTGCCCCGGGCCACAGCTCAAGACGCTGGAAAGTAT
TATTGTCACCGTGGCAACCTGACCATGTCATTCCACCTGGAGATCACTGCTCGGCCA

SEQ ID NO. 239
ATGGAGTTTGGGCTGAGCTGGTTTTCCTCGTTGCTCTTTTTAGAGGTGTCCAGTGTCAGGTTCAGCTGGTGCAGTCT
GGTGCTGAGGTGAAGAAGCCTGGTGCCTCAGTGAAGGTCTCCTGCAAGGCTTCTGGTTACACATTCACTGACTACTAC
ATGCACTGGGTGCGTCAGGCCCCTGGTCAAGGTCTTGAGTGGATGGGTCGTGTTAATCCTAACCGGAGGGGTACTACC
TACAACCAGAAATTCGAGGGCCGTGTCACCATGACCACAGACACATCCACGAGCACAGCCTACATGGAGCTGCGTAGC
CTGCGTTCTGACGACACGGCCGTGTATTACTGTGCGCGTGCGAACTGGCTTGACTACTGGGGCCAGGGCACCACCGTC
ACCGTCTCCTCCGCCTCCACCAAGGGCCCATCGGTCTTCCCGCTAGCGCCCTGCTCCAGGAGCACCTCCGAGAGCACA
GCCGCCCTGGGCTGCCTGGTCAAGGACTACTTCCCCGAACCGGTGACGGTGTCGTGGAACTCAGGCGCCCTGACCAGC
GGCGTGCACACCTTCCCGGCTGTCCTACAGTCCTCAGGACTCTACTCCCTCAGCAGCGTGGTGACCGTGCCCTCCAGC
AGCTTGGGCACGAAGACCTACACCTGCAACGTAGATCACAAGCCCAGCAACACCAAGGTGGACAAGAGAGTTGAGTCC
AAATATGGTCCCCCATGCCCACCCTGCCCAGCACCTGAGGCCGCCGGGGGACCATCAGTCTTCCTGTTCCCCCCAAAA
CCCAAGGACACTCTCATGATCTCCCGGACCCCTGAGGTCACGTGCGTGGTGGTGGACGTGAGCCAGGAAGACCCCGAG
GTCCAGTTCAACTGGTACGTGGATGGCGTGGAGGTGCATAATGCCAAGACAAAGCCGCGGGAGGAGCAGTTCAACAGC
ACGTACCGTGTGGTCAGCGTCCTCACCGTCCTGCACCAGGACTGGCTGAACGGCAAGGAGTACAAGTGCAAGGTCTCC
AACAAAGGCCTCCCGTCCTCCATCGAGAAAACCATCTCCAAAGCCAAAGGGCAGCCCCGAGAGCCACAGGTGTACACC
CTGCCCCCATCCCAGGAGGAGATGACCAAGAACCAGGTCAGCCTGACCTGCCTGGTCAAAGGCTTCTACCCCAGCGAC
ATCGCCGTGGAGTGGGAAAGCAATGGGCAGCCGGAGAACAACTACAAGACCACGCCTCCCGTGCTGGACTCCGACGGC
TCCTTCTTCCTCTACAGCAGGCTAACCGTGGACAAGAGCAGGTGGCAGGAGGGGAATGTCTTCTCATGCTCCGTGATG
CATGAGGCTCTGCACAACCACTACACACAGAAGAGCCTCTCCCTGTCTCTGGGTGGTGGAGGTGGGTCTGGAGGTGGA
GGATCTGGTGGAGGTGGGTCTCCCGAGGAACCTCTAGTGGTGAAGGTGGAAGAGGGAGATAACGCTGTGCTGCAGTGC
CTCAAGGGGACCTCAGATGGCCCCACTCAGCAGCTGACCTGGTCTCGGGAGTCCCCGCTTAAACCCTTCTTAAAACTC
AGCCTGGGGCTGCCAGGCCTGGGAATCCACATGAGGCCCCTGGCCATCTGGCTTTTCATCTTCAACGTCTCTCAACAG
ATGGGGGGCTTCTACCTGTGCCAGCCGGGGCCCCCCTCTGAGAAGGCCTGGCAGCCTGGCTGGACAGTCAATGTGGAG
GGCAGCGGGGAGCTGTTCCGGTGGAATGTTTCGGACCTAGGTGGCCTGGGCTGTGGCCTGAAGAACAGGTCCTCAGAG
GGCCCCAGCTCCCCTTCCGGGAAGCTCATGAGCCCCAAGCTGTATGTGTGGGCCAAAGACCGCCCTGAGATCTGGGAG
GGAGAGCCTCCGTGTCTCCCACCGAGGGACAGCCTGAACCAGAGCCTCAGCCAGGACCTCACCATGGCCCCTGGCTCC
ACACTCTGGCTGTCCTGTGGGGTACCCCCTGACTCTGTGTCCAGGGGCCCCCTCTCCTGGACCCATGTGCACCCCAAG
GGGCCTAAGTCATTGCTGAGCCTAGAGCTGAAGGACGATCGCCCGGCCAGAGATATGTGGGTAATGGAGACGGGTCTG
TTGTTGCCCCGGGCCACAGCTCAAGACGCTGGAAAGTATTATTGTCACCGTGGCAACCTGACCATGTCATTCCACCTG
GAGATCACTGCTCGGCCA

SEQ ID NO. 240
ATGGAGTTTGGGCTGAGCTGGTTTTCCTCGTTGCTCTTTTTAGAGGTGTCCAGTGTGAGGTGCAGCTGGTGGAGTCT
GGTGGTGGTCTTGTTCAACCTGGTGGTTCTCTTCGTCTTTCTTGTGCTGCTTCTGGTTTTAATATTAAAGATACTTAT
ATTCATTGGGTTCGTCAAGCTCCTGGTAAAGGTCTTGAATGGGTTGCTCGTATTTATCCTACTAATGGTTATACTCGT
TATGCTGATTCTGTTAAAGGTCGTTTTACTATTTCTGCTGATACTTCTAAAAATACTGCTTATCTTCAAATGAACTCT
CTTCGTGCTGAAGATACTGCTGTTTATTATTGTTCTCGTTGGGGTGGTGATGGTTTTTATGCTATGGATTATTGGGGT
CAAGGTACTCTTGTCACCGTCTCCTCAGCTAGCACCGGGGAGGTGGGTCTGGAGGTGGAGGATCTGGTGGAGGTGGG
TCTGACATCCAGATGACCCAGTCTCCTTCTTCTCTTTCTGCTTCTGTTGGTGATCGTGTTACTATTACTTGTCGTGCT
TCTCAAGATGTTAATACTGCTGTTGCTTGGTATCAACAAAAACCTGGTAAAGCTCCTAAACTTCTTATTTATTCTGCT

-continued

```
TCTTTTCTTTATTCTGGTGTTCCTTCTCGTTTTTCTGGTTCTCGTTCTGGTACTGATTTTACTCTTACTATTTCTTCT
CTTCAACCTGAAGATTTTGCTACTTATTATTGTCAACAACATTATACTACTCCTCCTACTTTTGGTCAAGGTACCAAG
GTGGAGATCAAACGTACGGACAAAACTCACACATCGCCACCGTCCCCAGCACCTGAAGCCGCGGGGGGACCGTCACCC
GAGGAACCTCTAGTGGTGAAGGTGGAAGAGGGAGATAACGCTGTGCTGCAGTGCCTCAAGGGGACCTCAGATGGCCCC
ACTCAGCAGCTGACCTGGTCTCGGGAGTCCCCGCTTAAACCCTTCTTAAAACTCAGCCTGGGGCTGCCAGGCCTGGGA
ATCCACATGAGGCCCCTGGCCATCTGGCTTTTCATCTTCAACGTCTCTCAACAGATGGGGGCTTCTACCTGTGCCAG
CCGGGGCCCCCTCTGAGAAGGCCTGGCAGCCTGGCTGGACAGTCAATGTGGAGGGCAGCGGGGAGCTGTTCCGGTGG
AATGTTTCGGACCTAGGTGGCCTGGGCTGTGGCCTGAAGAACAGGTCCTCAGAGGGCCCCAGCTCCCCTTCCGGGAAG
CTCATGAGCCCCAAGCTGTATGTGTGGGCCAAAGACCGCCCTGAGATCTGGGAGGGAGAGCCTCCGTGTCTCCCACCG
AGGGACAGCCTGAACCAGAGCCTCAGCCAGGACCTCACCATGGCCCCTGGCTCCACACTCTGGCTGTCCTGTGGGGTA
CCCCCTGACTCTGTGTCCAGGGGCCCCCTCTCCTGGACCCATGTGCACCCCAAGGGGCCTAAGTCATTGCTGAGCCTA
GAGCTGAAGGACGATCGCCCGGCCAGAGATATGTGGGTAATGGAGACGGGTCTGTTGTTGCCCCGGGCCACAGCTCAA
GACGCTGGAAAGTATTATTGTCACCGTGGCAACCTGACCATGTCATTCCACCTGGAGATCACTGCTCGGCCATCTAGA
GGGCCCCATCATCACCATCACCAT
```

SEQ ID NO. 241
```
ATGGAGTTTGGGCTGAGCTGGGTTTTCCTCGTTGCTCTTTTTAGAGGTGTCCAGTGTGAGGTGCAGCTGGTGGAGTCT
GGTGGTGGTCTTGTTCAACCTGGTGGTTCTCTTCGTCTTTCTTGTGCTGCTTCTGGTTTTAATATTAAAGATACTTAT
ATTCATTGGGTTCGTCAAGCTCCTGGTAAAGGTCTTGAATGGGTTGCTCGTATTTATCCTACTAATGGTTATACTCGT
TATGCTGATTCTGTTAAAGGTCGTTTTACTATTTCTGCTGATACTTCTAAAAATACTGCTTATCTTCAAATGAACTCT
CTTCGTGCTGAAGATACTGCTGTTTATTATTGTTCTCGTTGGGGTGGTGATGGTTTTTATGCTATGGATTATTGGGGT
CAAGGTACTCTTGTCACCGTCTCCTCAGCTAGCACCGGGGGAGGTGGGTCTGGAGGTGGAGGATCTGGTGGAGGTGGG
TCTGACATCCAGATGACCCAGTCTCCTTCTTCTCTTTCTGCTTCTGTTGGTGATCGTGTTACTATTACTTGTCGTGCT
TCTCAAGATGTTAATACTGCTGTTGCTTGGTATCAACAAAAACCTGGTAAAGCTCCTAAACTTCTTATTTATTCTGCT
TCTTTTCTTTATTCTGGTGTTCCTTCTCGTTTTTCTGGTTCTCGTTCTGGTACTGATTTTACTCTTACTATTTCTTCT
CTTCAACCTGAAGATTTTGCTACTTATTATTGTCAACAACATTATACTACTCCTCCTACTTTTGGTCAAGGTACCAAG
GTGGAGATCAAACGTACGGACAAAACTCACACATCGCCACCGTCCCCAGCACCTGAAGCCGCGGGGGGACCGTCACCC
GAGGAACCTCTAGTGGTGAAGGTGGAAGAGGGAGATAACGCTGTGCTGCAGTGCCTCAAGGGGACCTCAGATGGCCCC
ACTCAGCAGCTGACCTGGTCTCGGGAGTCCCCGCTTAAACCCTTCTTAAAACTCAGCCTGGGGCTGCCAGGCCTGGGA
ATCCACATGAGGCCCCTGGCCATCTGGCTTTTCATCTTCAACGTCTCTCAACAGATGGGGGCTTCTACCTGTGCCAG
CCGGGGCCCCCTCTGAGAAGGCCTGGCAGCCTGGCTGGACAGTCAATGTGGAGGGCAGCGGGGAGCTGTTCCGGTGG
AATGTTTCGGACCTAGGTGGCCTGGGCTGTGGCCTGAAGAACAGGTCCTCAGAGGGCCCCAGCTCCCCTTCCGGGAAG
CTCATGAGCCCCAAGCTGTATGTGTGGGCCAAAGACCGCCCTGAGATCTGGGAGGGAGAGCCTCCGTGTCTCCCACCG
AGGGACAGCCTGAACCAGAGCCTCAGCCAGGACCTCACCATGGCCCCTGGCTCCACACTCTGGCTGTCCTGTGGGGTA
CCCCCTGACTCTGTGTCCAGGGGCCCCCTCTCCTGGACCCATGTGCACCCCAAGGGGCCTAAGTCATTGCTGAGCCTA
GAGCTGAAGGACGATCGCCCGGCCAGAGATATGTGGGTAATGGAGACGGGTCTGTTGTTGCCCCGGGCCACAGCTCAA
GACGCTGGAAAGTATTATTGTCACCGTGGCAACCTGACCATGTCATTCCACCTGGAGATCACTGCTCGGCCAGACAAA
ACTCACACATGCCCACCGTGCCCAGCACCTGAACTCCTGGGGGGACCGTCAGTCTTCCTCTTCCCCCCAAAACCCAAG
GACACCCTCATGATCTCCCGGACCCCTGAGGTCACATGCGTGGTGGTGGACGTGAGCCACGAAGACCCTGAGGTCAAG
TTCAACTGGTACGTGGACGGCGTGGAGGTGCATAATGCCAAGACAAAGCCGCGGGAGGAGCAGTACAACAGCACGTAC
CGTGTGGTCAGCGTCCTCACCGTCCTGCACCAGGACTGGCTGAATGGCAAGGAGTACAAGTGCAAGGTCTCCAACAAA
GCCCTCCCAGCCCCCATCGAGAAAACCATCTCCAAAGCCAAAGGGCAGCCCCGAGAACCACAGGTGTACACCCTGCCC
```

-continued

CCATCCCGGGAGGAGATGACCAAGAACCAGGTCAGCCTGACCTGCCTGGTCAAAGGCTTCTATCCCAGCGACATCGCC
GTGGAGTGGGAGAGCAATGGGCAGCCGGAGAACAACTACAAGACCACGCCTCCCGTGCTGGACTCCGACGGCTCCTTC
TTCCTCTACAGCAAGCTCACCGTGGACAAGAGCAGGTGGCAGCAGGGGAACGTCTTCTCATGCTCCGTGATGCACGAG
GCTCTGCACAACCACTACACGCAGAAGAGCCTCTCCCTGTCTCCGGGT

SEQ ID NO. 242
ATGCCACCTCCTCGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCAGCAGCTGACCTGG
TCTCGGGAGTCCCCGCTTAAACCCTTCTTAAAACTCAGCCTGGGGCTGCCAGGCCTGGGAATCCACATGAGGCCCCTG
GCCATCTGGCTTTTCATCTTCAACGTCTCTCAACAGATGGGGGGCTTCTACCTGTGCCAGCCGGGGCCCCCCTCTGAG
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGACAGCCTGAACCAG
AGCCTCAGCCAGGACCTCACCATGGCCCCTGGCTCCACACTCTGGCTGTCCTGTGGGGTACCCCCTGACTCTGTGTCC
AGGGGCCCCCTCTCCTGGACCCATGTGCACCCCAAGGGGCCTAAGTCATTGCTGAGCCTAGAGCTGAAGGACGATCGC
CCGGCCAGAGATATGTGGGTAATGGAGACGGGTCTGTTGTTGCCCCGGGCCACAGCTCAAGACGCTGGAAAGTATTAT
TGTCACCGTGGCAACCTGACCATGTCATTCCACCTGGAGATCACTGCTCGGCCAGGGGAGGTGGGTCTGGAGGTGGA
GGATCTGGTGGAGGTGGGTCTGGTGGAGGTGGGTCTGAGGTGCAGCTGGTGGAGTCTGGTGGTGGTCTTGTTCAACCT
GGTGGTTCTCTTCGTCTTTCTTGTGCTGCTTCTGGTTTTAATATTAAAGATACTTATATTCATTGGGTTCGTCAAGCT
CCTGGTAAAGGTCTTGAATGGGTTGCTCGTATTTATCCTACTAATGGTTATACTCGTTATGCTGATTCTGTTAAAGGT
CGTTTTACTATTTCTGCTGATACTTCTAAAAATACTGCTTATCTTCAAATGAACTCTCTTCGTGCTGAAGATACTGCT
GTTTATTATTGTTCTCGTTGGGGTGGTGATGGTTTTTATGCTATGGATTATTGGGGTCAAGGTACTCTTGTCACCGTC
TCCTCAGCTAGCACCGGGGGAGGTGGGTCTGGAGGTGGAGGATCTGGTGGAGGTGGGTCTGACATCCAGATGACCCAG
TCTCCTTCTTCTCTTTCTGCTTCTGTTGGTGATCGTGTTACTATTACTTGTCGTGCTTCTCAAGATGTTAATACTGCT
GTTGCTTGGTATCAACAAAAACCTGGTAAAGCTCCTAAACTTCTTATTTATTCTGCTTCTTTTCTTTATTCTGGTGTT
CCTTCTCGTTTTTCTGGTTCTCGTTCTGGTACTGATTTTACTCTTACTATTTCTTCTCTTCAACCTGAAGATTTTGCT
ACTTATTATTGTCAACAACATTATACTACTCCTCCTACTTTTGGTCAAGGTACCAAGGTGGAGATCAAACGTACGTCT
AGAGGGCCCCATCATCACCATCACCAT

SEQ ID NO. 243
ATGCCACCTCCTCGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCAGCAGCTGACCTGG
TCTCGGGAGTCCCCGCTTAAACCCTTCTTAAAACTCAGCCTGGGGCTGCCAGGCCTGGGAATCCACATGAGGCCCCTG
GCCATCTGGCTTTTCATCTTCAACGTCTCTCAACAGATGGGGGGCTTCTACCTGTGCCAGCCGGGGCCCCCCTCTGAG
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGACAGCCTGAACCAG
AGCCTCAGCCAGGACCTCACCATGGCCCCTGGCTCCACACTCTGGCTGTCCTGTGGGGTACCCCCTGACTCTGTGTCC
AGGGGCCCCCTCTCCTGGACCCATGTGCACCCCAAGGGGCCTAAGTCATTGCTGAGCCTAGAGCTGAAGGACGATCGC
CCGGCCAGAGATATGTGGGTAATGGAGACGGGTCTGTTGTTGCCCCGGGCCACAGCTCAAGACGCTGGAAAGTATTAT
TGTCACCGTGGCAACCTGACCATGTCATTCCACCTGGAGATCACTGCTCGGCCAGGGGAGGTGGGTCTGGAGGTGGA
GGATCTGGTGGAGGTGGGTCTGGTGGAGGTGGGTCTGAGGTGCAGCTGGTGGAGTCTGGTGGTGGTCTTGTTCAACCT
GGTGGTTCTCTTCGTCTTTCTTGTGCTGCTTCTGGTTTTAATATTAAAGATACTTATATTCATTGGGTTCGTCAAGCT
CCTGGTAAAGGTCTTGAATGGGTTGCTCGTATTTATCCTACTAATGGTTATACTCGTTATGCTGATTCTGTTAAAGGT

-continued

CGTTTTACTATTTCTGCTGATACTTCTAAAAATACTGCTTATCTTCAAATGAACTCTCTTCGTGCTGAAGATACTGCT

GTTTATTATTGTTCTCGTTGGGGTGGTGATGTTTTTATGCTATGGATTATTGGGGTCAAGGTACTCTTGTCACCGTC

TCCTCAGCTAGCACCGGGGGAGGTGGGTCTGGAGGTGGAGGATCTGGTGGAGGTGGGTCTGACATCCAGATGACCCAG

TCTCCTTCTTCTCTTTCTGCTTCTGTTGGTGATCGTGTTACTATTACTTGTCGTGCTTCTCAAGATGTTAATACTGCT

GTTGCTTGGTATCAACAAAAACCTGGTAAAGCTCCTAAACTTCTTATTTATTCTGCTTCTTTTCTTTATTCTGGTGTT

CCTTCTCGTTTTTCTGGTTCTCGTTCTGGTACTGATTTTACTCTTACTATTTCTTCTCTTCAACCTGAAGATTTTGCT

ACTTATTATTGTCAACAACATTATACTACTCCTCCTACTTTTGGTCAAGGTACCAAGGTGGAGATCAAACGTACGGAC

AAAACTCACACATGCCCACCGTGCCCAGCACCTGAACTCCTGGGGGGACCGTCAGTCTTCCTCTTCCCCCCAAAACCC

AAGGACACCCTCATGATCTCCCGGACCCCTGAGGTCACATGCGTGGTGGTGGACGTGAGCCACGAAGACCCTGAGGTC

AAGTTCAACTGGTACGTGGACGGCGTGGAGGTGCATAATGCCAAGACAAAGCCGCGGGAGGAGCAGTACAACAGCACG

TACCGTGTGGTCAGCGTCCTCACCGTCCTGCACCAGGACTGGCTGAATGGCAAGGAGTACAAGTGCAAGGTCTCCAAC

AAAGCCCTCCCAGCCCCCATCGAGAAAACCATCTCCAAAGCCAAAGGGCAGCCCCGAGAACCACAGGTGTACACCCTG

CCCCCATCCCGGGAGGAGATGACCAAGAACCAGGTCAGCCTGACCTGCCTGGTCAAAGGCTTCTATCCCAGCGACATC

GCCGTGGAGTGGGAGAGCAATGGGCAGCCGGAGAACAACTACAAGACCACGCCTCCCGTGCTGGACTCCGACGGCTCC

TTCTTCCTCTACAGCAAGCTCACCGTGGACAAGAGCAGGTGGCAGCAGGGGAACGTCTTCTCATGCTCCGTGATGCAC

GAGGCTCTGCACAACCACTACACGCAGAAGAGCCTCTCCCTGTCTCCGGGT

SEQ ID NO. 246

AAGCTTAATTTAAGGCAGGATGTCTCAGAGTCTGGGAAAATCCCACTTTCCTCCTGCTACACCTTACAGTTGTGAGAA

AGCACATTTCAGACAACAGGGAAAACCCATACTTCACCACAACAACACACTATACATTGTCGGTCCACTGGAGCATA

AATTAAAGAGAAACAATGTAGTCAAGCAAGTAGGCGGCAAGAGGAAGGGGCGGAGACATCATCAGGGAGTATAAACT

CTGAGATGCCTCAGAGCCTCACAGACTCAACAAGAGCTCCAGCAAAGACTTTCACTGTAGCTTGACTTGACCTGAGAT

TAACTAGGGAATCTTGAGAATAAAGAAGCTTAACTAGTTAGCGGACCGACGCGTACGCGGCCGCTCGAGATGGAGAGC

GACGAGAGCGGCCTGCCCGCCATGGAGATCGAGTGCCGCATCACCGGCACCCTGAACGGCGTGGAGTTCGAGCTGGTG

GGCGGCGGAGAGGGCACCCCCGAGCAGGGCCGCATGACCAACAAGATGAAGAGCACCAAAGGCGCCCTGACCTTCAGC

CCCTACCTGCTGAGCCACGTGATGGGCTACGGCTTCTACCACTTCGGCACCTACCCCAGCGGCTACGAGAACCCCTTC

CTGCACGCCATCAACAACGGCGGCTACACCAACACCCGCATCGAGAAGTACGAGGACGGCGGCGTGCTGCACGTGAGC

TTCAGCTACCGCTACGAGGCCGGCCGCGTGATCGGCGACTTCAAGGTGATGGGCACCGGCTTCCCCGAGGACAGCGTG

ATCTTCACCGACAAGATCATCCGCAGCAACGCCACCGTGGAGCACCTGCACCCCATGGGCGATAACGATCTGGATGGC

AGCTTCACCCGCACCTTCAGCCTGCGCGACGCGGCTACTACAGCTCCGTGGTGGACAGCCACATGCACTTCAAGAGC

GCCATCCACCCCAGCATCCTGCAGAACGGGGGCCCCATGTTCGCCTTCCGCCGCGTGGAGGAGGATCACAGCAACACC

GAGCTGGGCATCGTGGAGTACCAGCACGCCTTCAAGACCCCGGATGCAGATGCCGGTGAAGAAAGAGTT

SEQ ID NO. 247

AAGCTTTAACGAAGACAGGGCCATGTAGAGGGCCCCAGGGAGTGAAAGGGCCTCCAGGACCTCCAGGTATGGAATACA

GGGGACGTTTAAGAAGATATGGCCACACACTGGGGCCCTGAGAAGTGAGAGCTTCATGAAAAAAATCAGGGACCCCAG

AGTTCCTTGGAAGCCAAGACTGAAACCAGCATTATGAGTCTCCGGGTCAGAATGAAAGAAGAAGGCCTGCCCCAGTGG

GGTCTGTGAATTCCCGGGGTGATTTCACTCCCCGGGGCTGTCCCAGGCTTGTCCCTGCTACCCCCACCCAGCCTTTC

CTGAGGCCTCAAGCCTGCCACCAAGCCCCCAGCTCCTTCTCCCCGCAGGGACCCAAACACAGGCCTCGGGACTCAACA

CAGCTTTTCCCTCCAACCCCGTTTTCTCTCCCTCAAGGACTCAGCTTTCTGAGGCCCCTCCCAGTTCTAGTTCTATCT

TTTTCCTGCATCCTGTCTGGAAGTTAGAAGGAAACAGACCACAGACCTGGTCCCCAAAAGAAATGGAGGCAATAGGTT

TTGAGGGGCATGGGACGGGGTTCAGCCTCCAGGGTCCTACACACAAATCAGTCAGTGGCCCAGAAGACCCCCTCGGA

ATCGGAGCAGGGAGGATGGGGAGTGTGAGGGGTATCCTTGATGCTTGTGTGTCCCCAACTTTCCAAATCCCCGCCCCC

-continued

```
GCGATGGAGAAGAAACCGAGACAGAAGGTGCAGGGCCCACTACCGCTTCCTCCAGATGAGCTCATGGGTTTCTCCACC
AAGGAAGTTTTCCGCTGGTTGAATGATTCTTTCCCCGCCCTCCTCTCGCCCCAGGGACATATAAAGGCAGTTGTTGGC
ACACCCAGCCAGCAGACGCTCCCTCAGCAAGGACAGCAGAGGACCAGCTAAGAGGGAGAGAAGCAACTACAGACCCCC
CCTGAAAACAACCCTCAGACGCCACATCCCCTGACAAGCTGCCAGGCAGGTTCTCTTCCTCTCACATACTGACCCACG
GCTCCACCCTCTCTCCCCTGGAAAGGACACAAGCTTAACTAGTTAGCGGACCGACGCGTACGCGGCCGCTCGAGATGG
AGAGCGACGAGAGCGGCCTGCCCGCCATGGAGATCGAGTGCCGCATCACCGGCACCCTGAACGGCGTGGAGTTCGAGC
TGGTGGGCGGCGGAGAGGGCACCCCCGAGCAGGGCCGCATGACCAACAAGATGAAGAGCACCAAAGGCGCCCTGACCT
TCAGCCCCTACCTGCTGAGCCACGTGATGGGCTACGGCTTCTACCACTTCGGCACCTACCCCAGCGGCTACGAGAACC
CCTTCCTGCACGCCATCAACAACGGCGGCTACACCAACACCCGCATCGAGAAGTACGAGGACGGCGGCGTGCTGCACG
TGAGCTTCAGCTACCGCTACGAGGCCGGCCGCGTGATCGGCGACTTCAAGGTGATGGGCACCGGCTTCCCCGAGGACA
GCGTGATCTTCACCGACAAGATCATCCGCAGCAACGCCACCGTGGAGCACCTGCACCCCATGGGCGATAACGATCTGG
ATGGCAGCTTCACCCGCACCTTCAGCCTGCGCGACGGCGGCTACTACAGCTCCGTGGTGGACAGCCACATGCACTTCA
AGAGCGCCATCCACCCCAGCATCCTGCAGAACGGGGGCCCCATGTTCGCCTTCCGCCGCGTGGAGGAGGATCACAGCA
ACACCGAGCTGGGCATCGTGGAGTACCAGCACGCCTTCAAGACCCCGGATGCAGATGCCGGTGAAGAAAGAGTT
```

SEQ ID NO. 248
```
AAGCTTGGGAGAAGCTAGACTTAAAATCTTCCATTGCAGCTGTAAACACATCTGGACAATAGTCTGTTTTCTGCATTT
GTGAATCCCACACCCATGGAACTATGAATCGTGCATCAGAGTTATTTAAAACCACCGTGCATGGAGTGAACCAATACC
GAGGTGTTTGCTTATCATTTTCCTTTGAGCACACAGCACAGCCTTGAACTCAGTGACACTCCTAAGAGGGCTCTAGGG
TCAGGCCAACTTAGATGAGATGCTAGTCTTTAGCTAAAGATGCCCTTCCACCCCGTTGCACGACCTTGCTTCTCAGT
CTTTGTTGAGTCTTCTGGGGGAGAATCCCCCTAGAGGACTCAGTTTACAAAACCCTAAGTGAGACCACTGCCAAGAAG
TGCTTGCTCACCCCTCCTGCCGCGGCAGGGAATCCCCCTTTCCTTGTACAGGCAAAACACAAAAAAGGACTCATAAGT
GAAGCCTGATCCTTCTCACCAAACACTGCCCACACCTCCTAGTAATTGAACTTGAAAAAAAAAACTGGTTTGAAAAAT
TACCGCAAACCATATTGTCATAAAAAAAAAAAAAAACACTTCCTATATGAGATCACAGAACAGAGTAGGCACAAGTTC
CTGCTGAGCAGATCAGCCTAATGCTTAAATAGAACAACTCCTGGCTGTCATTGACATTGTCTAAAAGCCAAGATGACA
GACTGAGAGGCCTGAGCCCTTGTTCTGGCATTCTCCCAGGAAGATGCAGTAAAGGGGTTGACCCAATATACAAGCTTA
ACTAGTTAGCGGACCGACGCGTACGCGGCCGCTCGAGATGGAGAGCGACGAGAGCGGCCTGCCCGCCATGGAGATCGA
GTGCCGCATCACCGGCACCCTGAACGGCGTGGAGTTCGAGCTGGTGGGCGGCGGAGAGGGCACCCCCGAGCAGGGCCG
CATGACCAACAAGATGAAGAGCACCAAAGGCGCCCTGACCTTCAGCCCCTACCTGCTGAGCCACGTGATGGGCTACGG
CTTCTACCACTTCGGCACCTACCCCAGCGGCTACGAGAACCCCTTCCTGCACGCCATCAACAACGGCGGCTACACCAA
CACCCGCATCGAGAAGTACGAGGACGGCGGCGTGCTGCACGTGAGCTTCAGCTACCGCTACGAGGCCGGCCGCGTGAT
CGGCGACTTCAAGGTGATGGGCACCGGCTTCCCCGAGGACAGCGTGATCTTCACCGACAAGATCATCCGCAGCAACGC
CACCGTGGAGCACCTGCACCCCATGGGCGATAACGATCTGGATGGCAGCTTCACCCGCACCTTCAGCCTGCGCGACGG
CGGCTACTACAGCTCCGTGGTGGACAGCCACATGCACTTCAAGAGCGCCATCCACCCCAGCATCCTGCAGAACGGGGG
CCCCATGTTCGCCTTCCGCCGCGTGGAGGAGGATCACAGCAACACCGAGCTGGGCATCGTGGAGTACCAGCACGCCTT
CAAGACCCCGGATGCAGATGCCGGTGAAGAAAGAGTT
```

SEQ ID NO. 249
```
AAGCTTGATATCGAATTAGGAGGAAAACTGTTTCATACAGAAGGCGTCAATTAGGAGGAAAAACTGTTTCATACAGAA
GGCGTCAATTAGGAGGAAAAACTGTTTCATACAGAAGGCGTCAATTGGTCCCATCGAATTAGGAGGAAAAACTGTTTC
ATACAGAAGGCGTCAATTAGGAGGAAAAACTGTTTCATACAGAAGGCGTCAATTAGGAGGAAAAACTGTTTCATACAG
AAGGCGTCAATTGGTCCCGGGACATTTTGACACCCCCATAATATTTTTCCAGAATTAACAGTATAAATTGCATCTCTT
GTTCAAGAGTTCCCTATCACTCTCTTTAATCACTACTCACAGTAACCTCAACTCCTGAAGCTTAACTAGTTAGCGGAC
CGACGCGTACGCGGCCGCTCGAGATGGAGAGCGACGAGAGCGGCCTGCCCGCCATGGAGATCGAGTGCCGCATCACCG
```

-continued

```
GCACCCTGAACGGCGTGGAGTTCGAGCTGGTGGGCGGCGGAGAGGGCACCCCCGAGCAGGGCCGCATGACCAACAAGA
TGAAGAGCACCAAAGGCGCCCTGACCTTCAGCCCCTACCTGCTGAGCCACGTGATGGGCTACGGCTTCTACCACTTCG
GCACCTACCCCAGCGGCTACGAGAACCCCTTCCTGCACGCCATCAACAACGGCGGCTACACCAACACCCGCATCGAGA
AGTACGAGGACGGCGGCGTGCTGCACGTGAGCTTCAGCTACCGCTACGAGGCCGGCCGCGTGATCGGCGACTTCAAGG
TGATGGGCACCGGCTTCCCCGAGGACAGCGTGATCTTCACCGACAAGATCATCCGCAGCAACGCCACCGTGGAGCACC
TGCACCCCATGGGCGATAACGATCTGGATGGCAGCTTCACCCGCACCTTCAGCCTGCGCGACGGCGGCTACTACAGCT
CCGTGGTGGACAGCCACATGCACTTCAAGAGCGCCATCCACCCCAGCATCCTGCAGAACGGGGGCCCCATGTTCGCCT
TCCGCCGCGTGGAGGAGGATCACAGCAACACCGAGCTGGGCATCGTGGAGTACCAGCACGCCTTCAAGACCCCGGATG
CAGATGCCGGTGAAGAAAGAGTT
```

SEQ ID NO. 250
```
ATGCCACCTCCTCGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCAGCAGCTGACCTGG
TCTCGGGAGTCCCCGCTTAAACCCTTCTTAAAACTCAGCCTGGGGCTGCCAGGCCTGGGAATCCACATGAGGCCCCTG
GCCATCTGGCTTTTCATCTTCAACGTCTCTCAACAGATGGGGGGCTTCTACCTGTGCCAGCCGGGGCCCCCCTCTGAG
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGACAGCCTGAACCAG
AGCCTCAGCCAGGACCTCACCATGGCCCTGGCTCCACACTCTGGCTGTCCTGTGGGGTACCCCCTGACTCTGTGTCC
AGGGGCCCCCTCTCCTGGACCCATGTGCACCCCAAGGGGCCTAAGTCATTGCTGAGCCTAGAGCTGAAGGACGATCGC
CCGGCCAGAGATATGTGGGTAATGGAGACGGGTCTGTTGTTGCCCCGGGCCACAGCTCAAGACGCTGGAAAGTATTAT
TGTCACCGTGGCAACCTGACCATGTCATTCCACCTGGAGATCACTGCTCGGCCAGTACTATGGCACTGGCTGCTGAGG
ACTGGTGGCTGGAAGGGAGGAGGTGGGTCTGGAGGTGGAGGATCTGGTGGAGGTGGGTCTGGAGGAGGTGGGTCTCAG
GTGCAGCTGCAGGAGTCGGGCCCAGGACTGGTGAAGCCTTCGGAGACCCTGTCCCTCACCTGCACTGTCTCTGGTGGC
TCCGTCAGCAGTGGTGATTACTACTGGACCTGGATCCGGCAGTCCCCAGGGAAGGGACTGGAGTGGATTGGACACATC
TATTACAGTGGGAACACCAATTATAACCCCTCCCTCAAGAGTCGACTCACCATATCAATTGACACGTCCAAGACTCAG
TTCTCCCTGAAGCTGAGTTCTGTGACCGCTGCGGACACGGCCATTTATTACTGTGTGCGAGATCGAGTGACTGGTGCT
TTTGATATCTGGGGCCAAGGGACAATGGTCACCGTCTCTTCAGCCTCCACCAAGGGCCCATCGGTCTTCCCCCTGGCG
CCCTGCTCCAGGAGCACCTCCGAGAGCACAGCGGCCCTGGGCTGCCTGGTCAAGGACTACTTCCCTGAACCGGTGACG
GTGTCGTGGAACTCAGGCGCTCTGACCAGCGGCGTGCACACCTTCCCGGCTGTCCTACAGTCCTCAGGACTCTACTCC
CTCAGCAGCGTGGTGACCGTGCCCTCCAGCAACTTCGGCACCCAGACCTACACCTGCAACGTAGATCACAAGCCCAGC
AATACCAAGGTGGACAAGACAGTTGAGCGCAAATGTTGTGTCGAGTGCCCACCGTGCCCAGCACCACCTGTGGCAGGA
CCGTCAGTCTTCCTCTTCCCCCCAAAACCCAAGGACACCCTCATGATCTCCCGGACCCCTGAGGTCACGTGCGTGGTG
GTGGACGTGAGCCACGAAGACCCCGAGGTCCAGTTCAACTGGTACGTGGACGGCGTGGAGGTGCATAATGCCAAGACA
AAGCCACGGGAGGAGCAGTTCCAAAGCACGTTCCGTGTGGTCAGCGTCCTCACCGTCGTGCACCAGGACTGGCTGAAC
GGCAAGGAGTACAAGTGCAAGGTCTCCAACAAAGGCCTCCCAGCCCCCATCGAGAAAACCATCTCCAAAACCAAAGGG
CAGCCCCGAGAACCACAGGTGTACACCCTGCCCCCATCCCGGGAGGAGATGACCAAGAACCAGGTCAGCCTGACCTGC
CTGGTCAAAGGCTTCTACCCCAGCGACATCGCCGTGGAGTGGGAGAGCAATGGGCAGCCGGAGAACAACTACAAGACC
ACGCCTCCCATGCTGGACTCCGACGGCTCCTTCTTCCTCTACAGCAAGCTCACCGTGGACAAGAGCAGGTGGCAGCAG
GGGAACGTCTTCTCATGCTCCGTGATGCATGAGGCTCTGCACAACCACTACACGCAGAAGAGCCTCTCCCTGTCTCCG
GGT
```

SEQ ID NO. 251
ATGCCACCTCCTCGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCAGCAGCTGACCTGG
TCTCGGGAGTCCCCGCTTAAACCCTTCTTAAAACTCAGCCTGGGGCTGCCAGGCCTGGGAATCCACATGAGGCCCCTG
GCCATCTGGCTTTTCATCTTCAACGTCTCTCAACAGATGGGGGGCTTCTACCTGTGCCAGCCGGGGCCCCCCTCTGAG
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGACAGCCTGAACCAG
AGCCTCAGCCAGGACCTCACCATGGCCCCTGGCTCCACACTCTGGCTGTCCTGTGGGGTACCCCCTGACTCTGTGTCC
AGGGGCCCCCTCTCCTGGACCCATGTGCACCCCAAGGGGCCTAAGTCATTGCTGAGCCTAGAGCTGAAGGACGATCGC
CCGGCCAGAGATATGTGGGTAATGGAGACGGGTCTGTTGTTGCCCCGGGCCACAGCTCAAGACGCTGGAAAGTATTAT
TGTCACCGTGGCAACCTGACCATGTCATTCCACCTGGAGATCACTGCTCGGCCAGTACTATGGCACTGGCTGCTGAGG
ACTGGTGGCTGGAAGGGAGGAGGTGGGTCTGGAGGAGGTGGGTCTGGAGGTGGAGGATCTGGTGGAGGTGGGTCTCAG
GTTCAGCTGGTGCAGTCTGGTGCTGAGGTGAAGAAGCCTGGTGCCTCAGTGAAGGTCTCCTGCAAGGCTTCTGGTTAC
ACATTCACTGACTACTACATGCACTGGGTGCGTCAGGCCCCTGGTCAAGGTCTTGAGTGGATGGGTCGTGTTAATCCT
AACCGGAGGGGTACTACCTACAACCAGAAATTCGAGGGCCGTGTCACCATGACCACAGACACATCCACGAGCACAGCC
TACATGGAGCTGCGTAGCCTGCGTTCTGACGACACGGCCGTGTATTACTGTGCGCGTGCGAACTGGCTTGACTACTGG
GGCCAGGGCACCACCGTCACCGTCTCCTCCGCCTCCACCAAGGGCCCATCGGTCTTCCCGCTAGCGCCCTGCTCCAGG
AGCACCTCCGAGAGCACAGCCGCCCTGGGCTGCCTGGTCAAGGACTACTTCCCCGAACCGGTGACGGTGTCGTGGAAC
TCAGGCGCCCTGACCAGCGGCGTGCACACCTTCCCGGCTGTCCTACAGTCCTCAGGACTCTACTCCCTCAGCAGCGTG
GTGACCGTGCCCTCCAGCAGCTTGGGCACGAAGACCTACACCTGCAACGTAGATCACAAGCCCAGCAACACCAAGGTG
GACAAGAGAGTTGAGTCCAAATATGGTCCCCCATGCCCACCCTGCCCAGCACCTGAGGCCGCCGGGGGACCATCAGTC
TTCCTGTTCCCCCCAAAACCCAAGGACACTCTCATGATCTCCCGGACCCCTGAGGTCACGTGCGTGGTGGTGGACGTG
AGCCAGGAAGACCCCGAGGTCCAGTTCAACTGGTACGTGGATGGCGTGGAGGTGCATAATGCCAAGACAAAGCCGCGG
GAGGAGCAGTTCAACAGCACGTACCGTGTGGTCAGCGTCCTCACCGTCCTGCACCAGGACTGGCTGAACGGCAAGGAG
TACAAGTGCAAGGTCTCCAACAAAGGCCTCCCGTCCTCCATCGAGAAAACCATCTCCAAAGCCAAAGGGCAGCCCCGA
GAGCCACAGGTGTACACCCTGCCCCCATCCCAGGAGGAGATGACCAAGAACCAGGTCAGCCTGACCTGCCTGGTCAAA
GGCTTCTACCCCAGCGACATCGCCGTGGAGTGGGAAAGCAATGGGCAGCCGGAGAACAACTACAAGACCACGCCTCCC
GTGCTGGACTCCGACGGCTCCTTCTTCCTCTACAGCAGGCTAACCGTGGACAAGAGCAGGTGGCAGGAGGGGAATGTC
TTCTCATGCTCCGTGATGCATGAGGCTCTGCACAACCACTACACACAGAAGAGCCTCTCCCTGTCTCTG

SEQ ID NO. 252
ATGCCACCTCCTCGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCAGCAGCTGACCTGG
TCTCGGGAGTCCCCGCTTAAACCCTTCTTAAAACTCAGCCTGGGGCTGCCAGGCCTGGGAATCCACATGAGGCCCCTG
GCCATCTGGCTTTTCATCTTCAACGTCTCTCAACAGATGGGGGGCTTCTACCTGTGCCAGCCGGGGCCCCCCTCTGAG
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGACAGCCTGAACCAG
AGCCTCAGCCAGGACCTCACCATGGCCCCTGGCTCCACACTCTGGCTGTCCTGTGGGGTACCCCCTGACTCTGTGTCC
AGGGGCCCCCTCTCCTGGACCCATGTGCACCCCAAGGGGCCTAAGTCATTGCTGAGCCTAGAGCTGAAGGACGATCGC
CCGGCCAGAGATATGTGGGTAATGGAGACGGGTCTGTTGTTGCCCCGGGCCACAGCTCAAGACGCTGGAAAGTATTAT

-continued

TGTCACCGTGGCAACCTGACCATGTCATTCCACCTGGAGATCACTGCTCGGCCAGTACTATGGCACTGGCTGCTGAGG

ACTGGTGGCTGGAAGGGAGGAGGTGGGTCTGGAGGTGGAGGATCTGGTGGAGGTGGGTCTGGAGGAGGTGGGTCTCAG

GTGCAGCTGGTGCAGAGCGGCGCCGAGGACAAGAAGCCCGGCGAGAGCGTGAAGATCAGCTGCAAGGCCAGCGGCTAC

ACCTTCACCAACTACGGCATGAACTGGGTGAGGCAGGCCCCCGGCCAGGGCCTGAAGTGGATGGGCTGGATCAACACC

TACACCGGCGAGAGCACCTACGCCGACGACTTCAAGGGCAGGTTCGCCTTCAGCCTGGACACCAGCGCCAGCACCGCC

TACCTGCAGCTGAGCAGCCTGAGGGGCGAGGACACCGCCGTGTACTTCTGCGCCAGGTTCGCCATCAAGGGCGACTAC

TGGGGCCAGGGCACCACCGTGACCGTGAGCAGCGCCAGCACCGGCGGCGGCGGCAGCGGCGGCGGCGGCAGCGGCGGC

GGCGGCAGCGGCGGCGGCGGCAGCGACATCGTGATGACCCAGAGCCCCCTGAGCCTGGAGGTGAGCCCCGGCGAGCCC

GCCAGCATCAGCTGCAGGAGCACCAAGAGCCTGCTGCACAGCGACGGCATCACCTACCTGTACTGGTACCTGCAGAAG

CCCGGCCAGAGCCCCCAGCTGCTGATCTACCAGCTGAGCAACCTGGCCAGCGGCGTGCCCGACAGGTTCAGCAGCAGC

GGCAGCGGCACCGACTTCACCCTGAAGATCAGCAGGGTGGAGGCCGAGGACGAGGGCACCTACTACTGCGCCCAGAAC

CTGGAGATCCCCAGGACCTTCGGCCAGGGCACCAAGCTGGAGATCAAGAGGACCCATCATCACCATCACCAT

SEQ ID NO. 253
ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

GCCATCTGGCTTTTCATCTTCAACGTCTCTCAACAGATGGGGGGCTTCTACCTGTGCCAGCCGGGGCCCCCCTCTGAG

AAGGCCTGGCAGCCTGGCTGGACAGTCAATGTGGAGGGCAGCGGGGAGCTGTTCCGGTGGAATGTTTCGGACCTAGGT

GGCCTGGGCTGTGGCCTGAAGAACAGGTCCTCAGAGGGCCCCAGCTCCCCTTCCGGGAAGCTCATGAGCCCCAAGCTG

TATGTGTGGGCCAAAGACCGCCCTGAGATCTGGGAGGGAGAGCCTCCGTGTCTCCCACCGAGGGACAGCCTGAACCAG

AGCCTCAGCCAGGACCTCACCATGGCCCCTGGCTCCACACTCTGGCTGTCCTGTGGGGTACCCCCTGACTCTGTGTCC

AGGGGCCCCCTCTCCTGGACCCATGTGCACCCCAAGGGGCCTAAGTCATTGCTGAGCCTAGAGCTGAAGGACGATCGC

CCGGCCAGAGATATGTGGGTAATGGAGACGGGTCTGTTGTTGCCCCGGGCCACAGCTCAAGACGCTGGAAAGTATTAT

TGTCACCGTGGCAACCTGACCATGTCATTCCACCTGGAGATCACTGCTCGGCCAGTACTATGGCACTGGCTGCTGAGG

ACTGGTGGCTGGAAGGGAGGAGGTGGGTCTGGAGGTGGAGGATCTGGTGGAGGTGGGTCTGGAGGAGGTGGGTCTCAG

GTTCAGCTGGTGCAGTCTGGTGCTGAGGATGTGAAGCCTGATGCCTCAGTGAAGCTCTCCTGCAAGGCTTCTGGTTAC

ACATTCACTGACTACTACATGCACTGGGTGCGTCAGGCCCCTGGTCAAGGTCTTGAGTGGATGGGTCGTGTTAATCCT

AACCGGAGGGGTACTACCTACAACCAGAAATTCGAGGGCCGTGTCACCATGACCACAGACACATCCACGAGCACAGCC

TACATGCAGCTGAGTAGCCTGCGTGGTGAAGACACGGCCGTGTATTACTGTGCGCGTGCGAACTGGCTTGACTACTGG

GGCCAGGGCACCACCGTCACCGTCTCCTCCGCCTCCACCGGGGAGGTGGGTCTGGAGGTGGAGGATCTGGTGGAGGT

GGGTCTGGTGGAGGTGGGTCTGACATCCAGATGACCCAGTCTCCATCCTCCCTGGAGGCATCTGTAGGAGACAGAGTC

ACCATCACTTGCAGTGTCAGCTCAAGTGTATCCTCCATTTACTTGCACTGGTATCAGCAGAAACCAGGGAAAAGCCCT

AAGCTCCTGATCTATAGCACATCCAACTTGGCTTCTGGAGTCCCAGATAGGTTCAGTGGCAGTGGATCTGGGACAGAT

TTCACTCTCACCATCAGCAGTCTGCAAGCCGAAGATGAGGGCACTTACTACTGTCAAGTCTACAGTGGTTACCCGCTC

ACGTTCGGCGGAGGGACCAAGCTGGAGATCAAACGAACTCATCATCACCATCACCAT

SEQ ID NO. 254
ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

GCCATCTGGCTTTTCATCTTCAACGTCTCTCAACAGATGGGGGGCTTCTACCTGTGCCAGCCGGGGCCCCCCTCTGAG

AAGGCCTGGCAGCCTGGCTGGACAGTCAATGTGGAGGGCAGCGGGGAGCTGTTCCGGTGGAATGTTTCGGACCTAGGT

GGCCTGGGCTGTGGCCTGAAGAACAGGTCCTCAGAGGGCCCCAGCTCCCCTTCCGGGAAGCTCATGAGCCCCAAGCTG

-continued

```
TATGTGTGGGCCAAAGACCGCCCTGAGATCTGGGAGGGAGAGCCTCCGTGTCTCCCACCGAGGGACAGCCTGAACCAG

AGCCTCAGCCAGGACCTCACCATGGCCCCTGGCTCCACACTCTGGCTGTCCTGTGGGGTACCCCCTGACTCTGTGTCC

AGGGGCCCCCTCTCCTGGACCCATGTGCACCCCAAGGGGCCTAAGTCATTGCTGAGCCTAGAGCTGAAGGACGATCGC

CCGGCCAGAGATATGTGGGTAATGGAGACGGGTCTGTTGTTGCCCCGGGCCACAGCTCAAGACGCTGGAAAGTATTAT

TGTCACCGTGGCAACCTGACCATGTCATTCCACCTGGAGATCACTGCTCGGCCAGTACTATGGCACTGGCTGCTGAGG

ACTGGTGGCTGGAAGGGAGGAGGTGGGTCTGGAGGTGGAGGATCTGGTGGAGGTGGGTCTGGAGGAGGTGGGTCTCAG

GTGCAGCTGCAGGAGAGCGGCCCCGGCGACGTGAAGCCCAGCGAGACCCTGAGCCTGACCTGCACCGTGAGCGGCGGC

AGCGTGAGCAGCGGCGACTACTACTGGACCTGGATCAGGCAGAGCCCCGGCAAGGGCCTGGAGTGGATCGGCCACATC

TACTACAGCGGCAACACCAACTACAACCCCAGCCTGAAGAGCAGGCTGACCATCAGCATCGACACCAGCAAGACCACC

TTCAGCCTGCAGCTGAGCAGCGTGACCGGCGAGGACACCGCCATCTACTACTGCGTGAGGGACAGGGTGACCGGCGCC

TTCGACATCTGGGGCCAGGGCACCACCGTGACCGTGAGCAGCGCCAGCACCGGCGGCGGCGGCAGCGGCGGCGGCGGC

AGCGGCGGCGGCGGCAGCGGCGGCGGCGGCAGCGACATCCAGATGACCCAGAGCCCCAGCAGCCTGGAGGCCAGCGTG

GGCGACAGGGTGACCATCACCTGCCAGGCCAGCCAGGACATCAGCAACTACCTGAACTGGTACCAGCAGAAGCCCGGC

AAGAGCCCCAAGCTGCTGATCTACGACGCCAGCAACCTGGAGACCGGCGTGCCCGACAGGTTCAGCGGCAGCGGCAGC

GGCACCGACTTCACCTTCACCATCAGCAGCCTGCAGGCCGAGGACGAGGGCACCTACTTCTGCCAGCACTTCGACCAC

CTGCCCCTGGCCTTCGGCGGCGGCACCAAGCTGGAGATCAAGAGGACCCATCATCACCATCACCAT

SEQ ID NO. 255
ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

GCCATCTGGCTTTTCATCTTCAACGTCTCTCAACAGATGGGGGGCTTCTACCTGTGCCAGCCGGGGCCCCCCTCTGAG

AAGGCCTGGCAGCCTGGCTGGACAGTCAATGTGGAGGGCAGCGGGGAGCTGTTCCGGTGGAATGTTTCGGACCTAGGT

GGCCTGGGCTGTGGCCTGAAGAACAGGTCCTCAGAGGGCCCCAGCTCCCCTTCCGGGAAGCTCATGAGCCCCAAGCTG

TATGTGTGGGCCAAAGACCGCCCTGAGATCTGGGAGGGAGAGCCTCCGTGTCTCCCACCGAGGGACAGCCTGAACCAG

AGCCTCAGCCAGGACCTCACCATGGCCCCTGGCTCCACACTCTGGCTGTCCTGTGGGGTACCCCCTGACTCTGTGTCC

AGGGGCCCCCTCTCCTGGACCCATGTGCACCCCAAGGGGCCTAAGTCATTGCTGAGCCTAGAGCTGAAGGACGATCGC

CCGGCCAGAGATATGTGGGTAATGGAGACGGGTCTGTTGTTGCCCCGGGCCACAGCTCAAGACGCTGGAAAGTATTAT

TGTCACCGTGGCAACCTGACCATGTCATTCCACCTGGAGATCACTGCTCGGCCAGTACTATGGCACTGGCTGCTGAGG

ACTGGTGGCTGGAAGGGGGAGGTGGGTCTGGAGGTGGAGGATCTGGTGGAGGTGGGTCTGGTGGAGGTGGGTCTGAG

GTGCAGCTGGTGGAGTCTGGTGGTGGTCTTGTCAACCTGGTGGTTCTCTTCGTCTTTCTTGTGCTGCTTCTGGTTTT

AATATTAAAGATACTTATATTCATTGGGTTCGTCAAGCTCCTGGTAAAGGTCTTGAATGGGTTGCTCGTATTTATCCT

ACTAATGGTTATACTCGTTATGCTGATTCTGTTAAAGGTCGTTTTACTATTTCTGCTGATACTTCTAAAAATACTGCT

TATCTTCAAATGAACTCTCTTCGTGCTGAAGATACTGCTGTTTATTATTGTTCTCGTTGGGGTGGTGATGGTTTTTAT

GCTATGGATTATTGGGGTCAAGGTACTCTTGTCACCGTCTCCTCAGCTAGCACCGGGGAGGTGGGTCTGGAGGTGGA

GGATCTGGTGGAGGTGGGTCTGACATCCAGATGACCCAGTCTCCTTCTTCTCTTTCTGCTTCTGTTGGTGATCGTGTT

ACTATTACTTGTCGTGCTTCTCAAGATGTTAATACTGCTGTTGCTTGGTATCAACAAAAACCTGGTAAAGCTCCTAAA

CTTCTTATTTATTCTGCTTCTTTTCTTTATTCTGGTGTTCCTTCTCGTTTTTCTGGTTCTCGTTCTGGTACTGATTTT

ACTCTTACTATTTCTTCTCTTCAACCTGAAGATTTTGCTACTTATTATTGTCAACAACATTATACTACTCCTCCTACT

TTTGGTCAAGGTACCAAGGTGGAGATCAAACGTACGCATCATCACCATCACCAT
```

SEQ ID NO. 256
ATGCCACCTCCTCGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCAGCAGCTGACCTGG
TCTCGGGAGTCCCCGCTTAAACCCTTCTTAAAACTCAGCCTGGGGCTGCCAGGCCTGGGAATCCACATGAGGCCCCTG
GCCATCTGGCTTTTCATCTTCAACGTCTCTCAACAGATGGGGGGCTTCTACCTGTGCCAGCCGGGGCCCCCCTCTGAG
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGACAGCCTGAACCAG
AGCCTCAGCCAGGACCTCACCATGGCCCCTGGCTCCACACTCTGGCTGTCCTGTGGGGTACCCCCTGACTCTGTGTCC
AGGGGCCCCCTCTCCTGGACCCATGTGCACCCCAAGGGGCCTAAGTCATTGCTGAGCCTAGAGCTGAAGGACGATCGC
CCGGCCAGAGATATGTGGGTAATGGAGACGGGTCTGTTGTTGCCCCGGGCCACAGCTCAAGACGCTGGAAAGTATTAT
TGTCACCGTGGCAACCTGACCATGTCATTCCACCTGGAGATCACTGCTCGGCCAGTACTATGGCACTGGCTGCTGAGG
ACTGGTGGCTGGAAGGACAAAACTCACACATGCCCACCGTGCCCAGCACCTGAACTCCTGGGGGGACCGTCAGTCTTC
CTCTTCCCCCCAAAACCCAAGGACACCCTCATGATCTCCCGGACCCCTGAGGTCACATGCGTGGTGGTGGACGTGAGC
CACGAAGACCCTGAGGTCAAGTTCAACTGGTACGTGGACGGCGTGGAGGTGCATAATGCCAAGACAAAGCCGCGGGAG
GAGCAGTACAACAGCACGTACCGTGTGGTCAGCGTCCTCACCGTCCTGCACCAGGACTGGCTGAATGGCAAGGAGTAC
AAGTGCAAGGTCTCCAACAAAGCCCTCCCAGCCCCCATCGAGAAAACCATCTCCAAAGCCAAAGGGCAGCCCCGAGAA
CCACAGGTGTACACCCTGCCCCCATCCCGGGAGGAGATGACCAAGAACCAGGTCAGCCTGACCTGCCTGGTCAAAGGC
TTCTATCCCAGCGACATCGCCGTGGAGTGGGAGAGCAATGGGCAGCCGGAGAACAACTACAAGACCACGCCTCCCGTG
CTGGACTCCGACGGCTCCTTCTTCCTCTACAGCAAGCTCACCGTGGACAAGAGCAGGTGGCAGCAGGGGAACGTCTTC
TCATGCTCCGTGATGCACGAGGCTCTGCACAACCACTACACGCAGAAGAGCCTCTCCCTGTCTCCGGGTGGAGGAGGT
GGGTCTGGAGGTGGAGGATCTGGTGGAGGTGGGTCTGGAGGAGGTGGGTCTGAGGTGCAGCTGGTGGAGTCTGGTGGT
GGTCTTGTTCAACCTGGTGGTTCTCTTCGTCTTTCTTGTGCTGCTTCTGGTTTTAATATTAAAGATACTTATATTCAT
TGGGTTCGTCAAGCTCCTGGTAAAGGTCTTGAATGGGTTGCTCGTATTTATCCTACTAATGGTTATACTCGTTATGCT
GATTCTGTTAAAGGTCGTTTTACTATTTCTGCTGATACTTCTAAAAATACTGCTTATCTTCAAATGAACTCTCTTCGT
GCTGAAGATACTGCTGTTTATTATTGTTCTCGTTGGGGTGGTGATGGTTTTTATGCTATGGATTATTGGGTCAAGGT
ACTCTTGTCACCGTCTCCTCAGCTAGCACCGGGGGAGGTGGGTCTGGAGGTGGAGGATCTGGTGGAGGTGGGTCTGAC
ATCCAGATGACCCAGTCTCCTTCTTCTCTTTCTGCTTCTGTTGGTGATCGTGTTACTATTACTTGTCGTGCTTCTCAA
GATGTTAATACTGCTGTTGCTTGGTATCAACAAAAACCTGGTAAAGCTCCTAAACTTCTTATTTATTCTGCTTCTTTT
CTTTATTCTGGTGTTCCTTCTCGTTTTTCTGGTTCTCGTTCTGGTACTGATTTTACTCTTACTATTTCTTCTCTTCAA
CCTGAAGATTTTGCTACTTATTATTGTCAACAACATTATACTACTCCTCCTACTTTTGGTCAAGGTACCAAGGTGGAG
ATCAAACGTACG

SEQ ID NO. 257
ATGGAGCTGGCGGCCTTGTGCCGCTGGGGGCTCCTCCTCGCCCTCTTGCCCCCCGGAGCCGCGAGCACCCAAGTGTGC
ACCGGCACAGACATGAAGCTGCGGCTCCCTGCCAGTCCCGAGACCCACCTGGACATGCTCCGCCACCTCTACCAGGGC
TGCCAGGTGGTGCAGGGAAACCTGGAACTCACCTACCTGCCCACCAATGCCAGCCTGTCCTTCCTGCAGGATATCCAG
GAGGTGCAGGGCTACGTGCTCATCGCTCACAACCAAGTGAGGCAGGTCCCACTGCAGAGGCTGCGGATTGTGCGAGGC
ACCCAGCTCTTTGAGGACAACTATGCCCTGGCCGTGCTAGACAATGGAGACCCGCTGAACAATACCACCCCTGTCACA
GGGGCCTCCCCAGGAGGCCTGCGGGAGCTGCAGCTTCGAAGCCTCACAGAGATCTTGAAAGGAGGGGTCTTGATCCAG
CGGAACCCCCAGCTCTGCTACCAGGACACGATTTTGTGGAAGGACATCTTCCACAAGAACAACCAGCTGGCTCTCACA
CTGATAGACACCAACCGCTCTCGGGCCTGCCACCCCTGTTCTCCGATGTGTAAGGGCTCCCGCTGCTGGGGAGAGAGT

-continued

```
TCTGAGGATTGTCAGAGCCTGACGCGCACTGTCTGTGCCGGTGGCTGTGCCCGCTGCAAGGGGCCACTGCCCACTGAC
TGCTGCCATGAGCAGTGTGCTGCCGGCTGCACGGGCCCCAAGCACTCTGACTGCCTGGCCTGCCTCCACTTCAACCAC
AGTGGCATCTGTGAGCTGCACTGCCCAGCCCTGGTCACCTACAACACAGACACGTTTGAGTCCATGCCCAATCCCGAG
GGCCGGTATACATTCGGCGCCAGCTGTGTGACTGCCTGTCCCTACAACTACCTTTCTACGGACGTGGGATCCTGCACC
CTCGTCTGCCCCCTGCACAACCAAGAGGTGACAGCAGAGGATGGAACACAGCGGTGTGAGAAGTGCAGCAAGCCCTGT
GCCCGAGTGTGCTATGGTCTGGGCATGGAGCACTTGCGAGAGGTGAGGGCAGTTACCAGTGCCAATATCCAGGAGTTT
GCTGGCTGCAAGAAGATCTTTGGGAGCCTGGCATTTCTGCCGGAGAGCTTTGATGGGACCCAGCCTCCAACACTGCC
CCGCTCCAGCCAGAGCAGCTCCAAGTGTTTGAGACTCTGGAAGAGATCACAGGTTACCTATACATCTCAGCATGGCCG
GACAGCCTGCCTGACCTCAGCGTCTTCCAGAACCTGCAAGTAATCCGGGGACGAATTCTGCACAATGGCGCCTACTCG
CTGACCCTGCAAGGGCTGGGCATCAGCTGGCTGGGGCTGCGCTCACTGAGGGAACTGGGCAGTGGACTGGCCCTCATC
CACCATAACACCCACCTCTGCTTCGTGCACACGGTGCCCTGGGACCAGCTCTTTCGGAACCCGCACCAAGCTCTGCTC
CACACTGCCAACCGGCCAGAGGACGAGTGTGTGGGCGAGGGCCTGGCCTGCCACCAGCTGTGCGCCCGAGGGCACTGC
TGGGGTCCAGGGCCCACCCAGTGTGTCAACTGCAGCCAGTTCCTTCGGGGCCAGGAGTGCGTGGAGGAATGCCGAGTA
CTGCAGGGGCTCCCCAGGGAGTATGTGAATGCCAGGCACTGTTTGCCGTGCCACCCTGAGTGTCAGCCCCAGAATGGC
TCAGTGACCTGTTTTGGACCGGAGGCTGACCAGTGTGTGGCCTGTGCCCACTATAAGGACCCTCCCTTCTGCGTGGCC
CGCTGCCCCAGCGGTGTGAAACCTGACCTCTCCTACATGCCCATCTGGAAGTTTCCAGATGAGGAGGGCGCATGCCAG
CCTTGCCCCATCAACTGCACCCACTCCTGTGTGGACCTGGATGACAAGGGCTGCCCCGCCGAGCAGAGAGCCAGCCCT
CTGACGGGAGGAGGTGGGTCTGGAGGTGGAGGATCTGGTGGAGGTGGGTCTGGAGGAGGTGGGTCTCAGGTGCAGCTG
CAGGAGAGCGGCCCCGGCGACGTGAAGCCCAGCGAGACCCTGAGCCTGACCTGCACCGTGAGCGGCGGCAGCGTGAGC
AGCGGCGACTACTACTGGACCTGGATCAGGCAGAGCCCCGGCAAGGGCCTGGAGTGGATCGGCCACATCTACTACAGC
GGCAACACCAACTACAACCCCAGCCTGAAGAGCAGGCTGACCATCAGCATCGACACCAGCAAGACCACCTTCAGCCTG
CAGCTGAGCAGCGTGACCGGCGAGGACACCGCCATCTACTACTGCGTGAGGGACAGGGTGACCGGCGCCTTCGACATC
TGGGGCCAGGGCACCACCGTGACCGTGAGCAGCGCCAGCACCGGCGGCGGCGGCAGCGGCGGCGGCGGCAGCGGCGGC
GGCGGCAGCGGCGGCGGCGGCAGCGACATCCAGATGACCCAGAGCCCCAGCAGCCTGGAGGCCAGCGTGGGCGACAGG
GTGACCATCACCTGCCAGGCCAGCCAGGACATCAGCAACTACCTGAACTGGTACCAGCAGAAGCCCGGCAAGAGCCCC
AAGCTGCTGATCTACGACGCCAGCAACCTGGAGACCGGCGTGCCCGACAGGTTCAGCGGCAGCGGCAGCGGCACCGAC
TTCACCTTCACCATCAGCAGCCTGCAGGCCGAGGACGAGGGCACCTACTTCTGCCAGCACTTCGACCACCTGCCCCTG
GCCTTCGGCGGCGGCACCAAGCTGGAGATCAAGAGGACCCATCATCACCATCACCAT
```

SEQ ID NO. 258
```
ATGGAGCTGGCGGCCTTGTGCCGCTGGGGGCTCCTCCTCGCCCTCTTGCCCCCCGGAGCCGCGAGCAACCGGCCAGAG
GACGAGTGTGTGGGCGAGGGCCTGGCCTGCCACCAGCTGTGCGCCCGAGGGCACTGCTGGGGTCCAGGGCCCACCCAG
TGTGTCAACTGCAGCCAGTTCCTTCGGGGCCAGGAGTGCGTGGAGGAATGCCGAGTACTGCAGGGGCTCCCCAGGGAG
TATGTGAATGCCAGGCACTGTTTGCCGTGCCACCCTGAGTGTCAGCCCCAGAATGGCTCAGTGACCTGTTTTGGACCG
GAGGCTGACCAGTGTGTGGCCTGTGCCCACTATAAGGACCCTCCCTTCTGCGTGGCCCGCTGCCCCAGCGGTGTGAAA
CCTGACCTCTCCTACATGCCCATCTGGAAGTTTCCAGATGAGGAGGGCGCATGCCAGCCTTGCCCCATCAACTGCACC
CACTCCTGTGTGGACCTGGATGACAAGGGCTGCCCCGCCGAGCAGAGAGCCAGCCCTCTGACGGGAGGAGGTGGGTCT
GGAGGTGGAGGATCTGGTGGAGGTGGGTCTGGAGGAGGTGGGTCTCAGGTGCAGCTGCAGGAGAGCGGCCCCGGCGAC
GTGAAGCCCAGCGAGACCCTGAGCCTGACCTGCACCGTGAGCGGCGGCAGCGTGAGCAGCGGCGACTACTACTGGACC
TGGATCAGGCAGAGCCCCGGCAAGGGCCTGGAGTGGATCGGCCACATCTACTACAGCGGCAACACCAACTACAACCCC
AGCCTGAAGAGCAGGCTGACCATCAGCATCGACACCAGCAAGACCACCTTCAGCCTGCAGCTGAGCAGCGTGACCGGC
GAGGACACCGCCATCTACTACTGCGTGAGGGACAGGGTGACCGGCGCCTTCGACATCTGGGGCCAGGGCACCACCGTG
```

-continued

ACCGTGAGCAGCGCCAGCACCGGCGGCGGCGGCAGCGGCGGCGGCGGCAGCGGCGGCGGCGGCAGCGGCGGCGGCGGC

AGCGACATCCAGATGACCCAGAGCCCCAGCAGCCTGGAGGCCAGCGTGGGCGACAGGGTGACCATCACCTGCCAGGCC

AGCCAGGACATCAGCAACTACCTGAACTGGTACCAGCAGAAGCCCGGCAAGAGCCCCAAGCTGCTGATCTACGACGCC

AGCAACCTGGAGACCGGCGTGCCCGACAGGTTCAGCGGCAGCGGCAGCGGCACCGACTTCACCTTCACCATCAGCAGC

CTGCAGGCCGAGGACGAGGGCACCTACTTCTGCCAGCACTTCGACCACCTGCCCCTGGCCTTCGGCGGCGGCACCAAG

CTGGAGATCAAGAGGACCCATCATCACCATCACCAT

SEQ ID NO. 263
ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

GCCATCTGGCTTTTCATCTTCAACGTCTCTCAACAGATGGGGGGCTTCTACCTGTGCCAGCCGGGGCCCCCCTCTGAG

AAGGCCTGGCAGCCTGGCTGGACAGTCAATGTGGAGGGCAGCGGGGAGCTGTTCCGGTGGAATGTTTCGGACCTAGGT

GGCCTGGGCTGTGGCCTGAAGAACAGGTCCTCAGAGGGCCCCAGCTCCCCTTCCGGGAAGCTCATGAGCCCCAAGCTG

TATGTGTGGGCCAAAGACCGCCCTGAGATCTGGGAGGGAGAGCCTCCGTGTCTCCCACCGAGGGACAGCCTGAACCAG

AGCCTCAGCCAGGACCTCACCATGGCCCCTGGCTCCACACTCTGGCTGTCCTGTGGGGTACCCCCTGACTCTGTGTCC

AGGGGCCCCCTCTCCTGGACCCATGTGCACCCCAAGGGGCCTAAGTCATTGCTGAGCCTAGAGCTGAAGGACGATCGC

CCGGCCAGAGATATGTGGGTAATGGAGACGGGTCTGTTGTTGCCCCGGGCCACAGCTCAAGACGCTGGAAAGTATTAT

TGTCACCGTGGCAACCTGACCATGTCATTCCACCTGGAGATCACTGCTCGGCCAGTACTATGGCACTGGCTGCTGAGG

ACTGGTGGCTGGAAGGGAGGAGGTGGGTCTGGAGGTGGAGGATCTGGTGGAGGTGGGTCTGGAGGAGGTGGGTCTGAG

GTGCAGCTGCAGCAGTCTGGGGCTGAGCTGGTGAAGCCTGGGGCCTCAGTGAAGATGTCCTGCAAGGCTTCTGGCTAC

ACATTTACCAGTTACAATATGCACTGGGTAAAGCAGACACCTGGACAGGGCCTGGAATGGATTGGAGCTATTTATCCA

GGAAATGGTGATACTTCCTACAATCAGAAGTTCAAAGGCAAGGCCACATTGACTGCAGACAAATCCTCCAGCACAGCC

TACATGCAGCTCAGCAGCCTGACATCTGAGGACTCTGCGGACTATTACTGTGCAAGATCTAATTATTACGGTAGTAGC

TACTGGTTCTTCGATGTCTGGGGCGCAGGGACCACGGTCACCGTCTCCTCAGGCAGTACTAGCGGTGGTGGCTCCGGG

GGCGGTTCCGGTGGGGGCGGCAGCAGCGACATTGTGCTGACCCAATCTCCAGCTATCCTGTCTGCATCTCCAGGGGAG

AAGGTCACAATGACTTGCAGGGCCAGCTCAAGTGTAAATTACATGGACTGGTACCAGAAGAAGCCAGGATCCTCCCCC

AAACCCTGGATTTATGCCACATCCAACCTGGCTTCTGGAGTCCCTGCTCGCTTCAGTGGCAGTGGGTCTGGGACCTCT

TACTCTCTCACAATCAGCAGAGTGGAGGCTGAAGATGCTGCCACTTATTACTGCCAGCAGTGGAGTTTTAATCCACCC

ACGTTCGGAGGGGGGACCAAGCTGGAAATAAAACATCATCACCATCACCAT

SEQ ID NO. 264
ATGCATCTCCTCGGCCCCTGGCTCCTGCTCCTGGTTCTAGAATACTTGGCTTTCTCTGACTCAAGTAAATGGGTTTTT

GAGCACCCTGAAACCCTCTACGCCTGGGAGGGGCCTGCGTCTGGATCCCTGCACCTACAGAGCCCTAGATGGTGAC

CTGGAAAGCTTCATCCTGTTCCACAATCCTGAGTATAACAAGAACACCTCGAAGTTTGATGGGACAAGACTCTATGAA

AGCACAAAGGATGGGAAGGTTCCTTCTGAGCAGAAAAGGGTGCAATTCCTGGGAGACAAGAATAAGGCCTGCACACTG

AGTATCCACCCGGTGCACCTCAATGACAGTGGTCAGCTGGGGCTGAGGATGGAGTCCAAGACTGAGAAATGGATGGAA

CGAATACACCTCAATGTCTCTGAAAGGCCTTTTCCACCTCATATCCAGCTCCCTCCAGAAATTCAAGAGTCCCAGGAA

GTCACTCTGACCTGCTTGCTGAATTTCTCCTGCTATGGGTATCCGATCCAATTGCAGTGGCTCCTAGAGGGGGTTCCA

ATGAGGCAGGCTGCTGTCACCTCGACCTCCTTGACCATCAAGTCTGTCTTCACCCGGAGCGAGCTCAAGTTCTCCCCA

CAGTGGAGTCACCATGGGAAGATTGTGACCTGCCAGCTTCAGGATGCAGATGGGAAGTTCCTCTCCAATGACACGGTG

CAGCTGAACGTGAAGCACACCCCGAAGTTGGAGATCAAGGTCACTCCCAGTGATGCCATAGTGAGGGAGGGGACTCT

GTGACCATGACCTGCGAGGTCAGCAGCAGCAACCCGGAGTACACGACGGTATCCTGGCTCAAGGATGGGACCTCGCTG

AAGAAGCAGAATACATTCACGCTAAACCTGCGCGAAGTGACCAAGGACCAGAGTGGGAAGTACTGCTGTCAGGTCTCC

-continued

```
                                                                  AATGACGTGGGCCCGGGAAGGTCGGAAGAAGTGTTCCTGCAAGTGCAGTATGCCCCGGAAGGAGGAGGTGGGTCTGGA

GGTGGAGGATCTGGTGGAGGTGGGTCTGGAGGAGGTGGGTCTGACATCCAGATGACACAGACTACATCCTCCCTGTCT

GCCTCTCTGGGAGACAGAGTCACCATCAGTTGCAGGGCAAGTCAGGACATTAGTAAATATTTAAATTGGTATCAGCAG

AAACCAGATGGAACTGTTAAACTCCTGATCTACCATACATCAAGATTACACTCAGGAGTCCCATCAAGGTTCAGTGGC

AGTGGGTCTGGAACAGATTATTCTCTCACCATTAGCAACCTGGAGCAAGAAGATATTGCCACTTACTTTTGCCAACAG

GGTAATACGCTTCCGTACACGTTCGGAGGGGGACTAAGTTGGAAATAACAGGAGGAGGTGGGTCTGGAGGTGGAGGA

TCTGGTGGAGGTGGGTCTGGAGGAGGTGGGTCTGAGGTGAAACTGCAGGAGTCAGGACCTGGCCTGGTGGCGCCCTCA

CAGAGCCTGTCCGTCACATGCACTGTCTCAGGGGTCTCATTACCCGACTATGGTGTAAGCTGGATTCGCCAGCCTCCA

CGAAAGGGTCTGGAGTGGCTGGGAGTAATATGGGGTAGTGAAACCACATACTATAATTCAGCTCTCAAATCCAGACTG

ACCATCATCAAGGACAACTCCAAGAGCCAAGTTTTCTTAAAAATGAACAGTCTGCAAACTGATGACACAGCCATTTAC

TACTGTGCCAAACATTATTACTACGGTGGTAGCTATGCTATGGACTACTGGGGTCAAGGAACCTCAGTCACCGTCTCC

TCACATCATCACCATCACCAT
                                                                                     SEQ ID NO. 265
ATGCATCTCCTCGGCCCCTGGCTCCTGCTCCTGGTTCTAGAATACTTGGCTTTCTCTGACTCAAGTAAATGGGTTTTT

GAGCACCCTGAAACCCTCTACGCCTGGGAGGGGGCCTGCGTCTGGATCCCCTGCACCTACAGAGCCCTAGATGGTGAC

CTGGAAAGCTTCATCCTGTTCCACAATCCTGAGTATAACAAGAACACCTCGAAGTTTGATGGGACAAGACTCTATGAA

AGCACAAAGGATGGGAAGGTTCCTTCTGAGCAGAAAAGGGTGCAATTCCTGGGAGACAAGAATAAGGCCTGCACACTG

AGTATCCACCCGGTGCACCTCAATGACAGTGGTCAGCTGGGGCTGAGGATGGAGTCCAAGACTGAGAAATGGATGGAA

CGAATACACCTCAATGTCTCTGAAAGGCCTTTTCCACCTCATATCCAGCTCCCTCCAGAAATTCAAGAGTCCCAGGAA

GTCACTCTGACCTGCTTGCTGAATTTCTCCTGCTATGGGTATCCGATCCAATTGCAGTGGCTCCTAGAGGGGTTCCA

ATGAGGCAGGCTGCTGTCACCTCGACCTCCTTGACCATCAAGTCTGTCTTCACCCGGAGCGAGCTCAAGTTCTCCCCA

CAGTGGAGTCACCATGGGAAGATTGTGACCTGCCAGCTTCAGGATGCAGATGGGAAGTTCCTCTCCAATGACACGGTG

CAGCTGAACGTGAAGCACACCCCGAAGTTGGAGATCAAGGTCACTCCCAGTGATGCCATAGTGAGGGAGGGGGACTCT

GTGACCATGACCTGCGAGGTCAGCAGCAGCAACCCGGAGTACACGACGGTATCCTGGCTCAAGGATGGGACCTCGCTG

AAGAAGCAGAATACATTCACGCTAAACCTGCGCGAAGTGACCAAGGACCAGAGTGGGAAGTACTGCTGTCAGGTCTCC

AATGACGTGGGCCCGGGAAGGTCGGAAGAAGTGTTCCTGCAAGTGCAGTATGCCCCGGAAGGAGGAGGTGGGTCTGGA

GGTGGAGGATCTGGTGGAGGTGGGTCTGGAGGAGGTGGGTCTGAGGTGCAGCTGCAGCAGTCTGGGGCTGAGCTGGTG

AAGCCTGGGGCCTCAGTGAAGATGTCCTGCAAGGCTTCTGGCTACACATTTACCAGTTACAATATGCACTGGGTAAAG

CAGACACCTGGACAGGGCCTGGAATGGATTGGAGCTATTTATCCAGGAAATGGTGATACTTCCTACAATCAGAAGTTC

AAAGGCAAGGCCACATTGACTGCAGACAAATCCTCCAGCACAGCCTACATGCAGCTCAGCAGCCTGACATCTGAGGAC

TCTGCGGACTATTACTGTGCAAGATCTAATTATTACGGTAGTAGCTACTGGTTCTTCGATGTCTGGGGCGCAGGGACC

ACGGTCACCGTCTCCTCAGGCAGTACTAGCGGTGGTGGCTCCGGGGGCGGTTCCGGTGGGGGCGGCAGCAGCGACATT

GTGCTGACCCAATCTCCAGCTATCCTGTCTGCATCTCCAGGGGAGAAGGTCACAATGACTTGCAGGGCCAGCTCAAGT

GTAAATTACATGGACTGGTACCAGAAGAAGCCAGGATCCTCCCCCAAACCCTGGATTTATGCCACATCCAACCTGGCT

TCTGGAGTCCCTGCTCGCTTCAGTGGCAGTGGGTCTGGGACCTCTTACTCTCTCACAATCAGCAGAGTGGAGGCTGAA

GATGCTGCCACTTATTACTGCCAGCAGTGGAGTTTTAATCCACCCACGTTCGGAGGGGGGACCAAGCTGGAAATAAAA

CATCATCACCATCACCAT
                                                                                     SEQ ID NO. 266
AAGCTTGTTGACATTGATTATTGACTAGTTATTAATAGTAATCAATTACGGGGTCATTAGTTCATAGCCCATATATGG

AGTTCCGCGTTACATAACTTACGGTAAATGGCCCGCCTGGCTGACCGCCCAACGACCCCCGCCCATTGACGTCAATAA

TGACGTATGTTCCCATAGTAACGCCAATAGGGACTTTCCATTGACGTCAATGGGTGGAGTATTTACGGTAAACTGCCC
```

-continued

ACTTGGCAGTACATCAAGTGTATCATATGCCAAGTACGCCCCCTATTGACGTCAATGACGGTAAATGGCCCGCCTGGC
ATTATGCCCAGTACATGACCTTATGGGACTTTCCTACTTGGCAGTACATCTACGTATTAGTCATCGCTATTACCATGG
TGATGCGGTTTTGGCAGTACATCAATGGGCGTGGATAGCGGTTTGACTCACGGGGATTTCCAAGTCTCCACCCCATTG
ACGTCAATGGGAGTTTGTTTTGGCACCAAAATCAACGGGACTTTCCAAAATGTCGTAACAACTCCGCCCCATTGACGC
AAATGGGCGGTAGGCGTGTACGGTGGGAGGTCTATATAAGCAGAGCTCAAGCTTAACTAGTTAGCGGACCGACGCGTA
CGCGGCCGCTCGAGATGGAGAGCGACGAGAGCGGCCTGCCCGCCATGGAGATCGAGTGCCGCATCACCGGCACCCTGA
ACGGCGTGGAGTTCGAGCTGGTGGGCGGCGGAGAGGGCACCCCCGAGCAGGGCCGCATGACCAACAAGATGAAGAGCA
CCAAAGGCGCCCTGACCTTCAGCCCCTACCTGCTGAGCCACGTGATGGGCTACGGCTTCTACCACTTCGGCACCTACC
CCAGCGGCTACGAGAACCCCTTCCTGCACGCCATCAACAACGGCGGCTACACCAACACCCGCATCGAGAAGTACGAGG
ACGGCGGCGTGCTGCACGTGAGCTTCAGCTACCGCTACGAGGCCGGCCGCGTGATCGGCGACTTCAAGGTGATGGGCA
CCGGCTTCCCCGAGGACAGCGTGATCTTCACCGACAAGATCATCCGCAGCAACGCCACCGTGGAGCACCTGCACCCCA
TGGGCGATAACGATCTGGATGGCAGCTTCACCCGCACCTTCAGCCTGCGCGACGGCGGCTACTACAGCTCCGTGGTGG
ACAGCCACATGCACTTCAAGAGCGCCATCCACCCCAGCATCCTGCAGAACGGGGGCCCCATGTTCGCCTTCCGCCGCG
TGGAGGAGGATCACAGCAACACCGAGCTGGGCATCGTGGAGTACCAGCACGCCTTCAAGACCCCGGATGCAGATGCCG
GTGAAGAAAGAGTT

SEQ ID NO. 267

ATGCCACCTCCTCGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCAGCAGCTGACCTGG
TCTCGGGAGTCCCCGCTTAAACCCTTCTTAAAACTCAGCCTGGGGCTGCCAGGCCTGGGAATCCACATGAGGCCCCTG
GCCATCTGGCTTTTCATCTTCAACGTCTCTCAACAGATGGGGGGCTTCTACCTGTGCCAGCCGGGGCCCCCCTCTGAG
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCACCGAGGGACAGCCTGAACCAG
AGCCTCAGCCAGGACCTCACCATGGCCCCTGGCTCCACACTCTGGCTGTCCTGTGGGGTACCCCCTGACTCTGTGTCC
AGGGGCCCCCTCTCCTGGACCCATGTGCACCCCAAGGGGCCTAAGTCATTGCTGAGCCTAGAGCTGAAGGACGATCGC
CCGGCCAGAGATATGTGGGTAATGGAGACGGGTCTGTTGTTGCCCCGGGCCACAGCTCAAGACGCTGGAAAGTATTAT
TGTCACCGTGGCAACCTGACCATGTCATTCCACCTGGAGATCACTGCTCGGCCAGTACTATGGCACTGGCTGCTGAGG
ACTGGTGGCTGGAAGGGAGGAGGTGGGTCTGGAGGTGGAGGATCTGGTGGAGGTGGGTCTGGAGGAGGTGGGTCTGAC
ATCCTGATGACCCAATCTCCATCCTCCATGTCTGTATCTCTGGGAGACACAGTCAGCATCACTTGCCATTCAAGTCAG
GACATTAACAGTAATATAGGGTGGTTGCAGCAGAGACCAGGGAAATCATTTAAGGGCCTGATCTATCATGGAACCAAC
TTGGACGATGAAGTTCCATCAAGGTTCAGTGGCAGTGGATCTGGAGCCGATTATTCTCTCACCATCAGCAGCCTGGAA
TCTGAAGATTTTGCAGACTATTACTGTGTACAGTATGCTCAGTTTCCGTGGACGTTCGGTGGAGGCACCAAGCTCGAA
ATCAAACGTGGAGGAGGTGGGTCTGGAGGTGGAGGATCTGGTGGAGGTGGGTCTGGAGGAGGTGGGTCTATGAGAGTG
CTGATTCTTTTGTGGCTGTTCACAGCCTTTCCTGGTGTCCTGTCTGATGTGCAGCTTCAGGAGTCGGGACCTAGCCTG
GTGAAACCTTCTCAGTCTCTGTCCCTCACCTGCACTGTCACTGGCTACTCAATCACCAGTGATTTTGCCTGGAACTGG
ATCCGGCAGTTTCCAGGAAACAAGCTGGAGTGGATGGGCTACATAAGTTATAGTGGTAACACTAGGTACAACCCATCT
CTCAAAAGTCGAATCTCTATCACTCGAGACACATCCAAGAACCAATTCTTCCTGCAGTTGAATTCTGTGACTATTGAG
GACACAGCCACATATTACTGTGTAACGGCGGGACGCGGGTTTCCTTATTGGGGCCAAGGGACTCTGGTCACTGTCTCT
GCACATCATCACCATCACCAT

SEQ ID NO. 268

ATGCATCTCCTCGGCCCCTGGCTCCTGCTCCTGGTTCTAGAATACTTGGCTTTCTCTGACTCAAGTAAATGGGTTTTT
GAGCACCCTGAAACCCTCTACGCCTGGGAGGGGGCCTGCGTCTGGATCCCCTGCACCTACAGAGCCCTAGATGGTGAC

-continued

CTGGAAAGCTTCATCCTGTTCCACAATCCTGAGTATAACAAGAACACCTCGAAGTTTGATGGGACAAGACTCTATGAA

AGCACAAAGGATGGGAAGGTTCCTTCTGAGCAGAAAAGGGTGCAATTCCTGGGAGACAAGAATAAGGCCTGCACACTG

AGTATCCACCCGGTGCACCTCAATGACAGTGGTCAGCTGGGGCTGAGGATGGAGTCCAAGACTGAGAAATGGATGGAA

CGAATACACCTCAATGTCTCTGAAAGGCCTTTTCCACCTCATATCCAGCTCCCTCCAGAAATTCAAGAGTCCCAGGAA

GTCACTCTGACCTGCTTGCTGAATTTCTCCTGCTATGGGTATCCGATCCAATTGCAGTGGCTCCTAGAGGGGGTTCCA

ATGAGGCAGGCTGCTGTCACCTCGACCTCCTTGACCATCAAGTCTGTCTTCACCCGGAGCGAGCTCAAGTTCTCCCCA

CAGTGGAGTCACCATGGGAAGATTGTGACCTGCCAGCTTCAGGATGCAGATGGGAAGTTCCTCTCCAATGACACGGTG

CAGCTGAACGTGAAGCACACCCCGAAGTTGGAGATCAAGGTCACTCCCAGTGATGCCATAGTGAGGGAGGGGGACTCT

GTGACCATGACCTGCGAGGTCAGCAGCAGCAACCCGGAGTACACGACGGTATCCTGGCTCAAGGATGGGACCTCGCTG

AAGAAGCAGAATACATTCACGCTAAACCTGCGCGAAGTGACCAAGGACCAGAGTGGGAAGTACTGCTGTCAGGTCTCC

AATGACGTGGGCCCGGGAAGGTCGGAAGAAGTGTTCCTGCAAGTGCAGTATGCCCCGGAAGGAGGAGGTGGGTCTGGA

GGTGGAGGATCTGGTGGAGGTGGGTCTGGAGGAGGTGGGTCTGACATCCTGATGACCCAATCTCCATCCTCCATGTCT

GTATCTCTGGGAGACACAGTCAGCATCACTTGCCATTCAAGTCAGGACATTAACAGTAATATAGGGTGGTTGCAGCAG

AGACCAGGGAAATCATTTAAGGGCCTGATCTATCATGGAACCAACTTGGACGATGAAGTTCCATCAAGGTTCAGTGGC

AGTGGATCTGGAGCCGATTATTCTCTCACCATCAGCAGCCTGGAATCTGAAGATTTTGCAGACTATTACTGTGTACAG

TATGCTCAGTTTCCGTGGACGTTCGGTGGAGGCACCAAGCTCGAAATCAAACGTGGAGGAGGTGGGTCTGGAGGTGGA

GGATCTGGTGGAGGTGGGTCTGGAGGAGGTGGGTCTATGAGAGTGCTGATTCTTTTGTGGCTGTTCACAGCCTTTCCT

GGTGTCCTGTCTGATGTGCAGCTTCAGGAGTCGGGACCTAGCCTGGTGAAACCTTCTCAGTCTCTGTCCCTCACCTGC

ACTGTCACTGGCTACTCAATCACCAGTGATTTTGCCTGGAACTGGATCCGGCAGTTTCCAGGAAACAAGCTGGAGTGG

ATGGGCTACATAAGTTATAGTGGTAACACTAGGTACAACCCATCTCTCAAAAGTCGAATCTCTATCACTCGAGACACA

TCCAAGAACCAATTCTTCCTGCAGTTGAATTCTGTGACTATTGAGGACACAGCCACATATTACTGTGTAACGGCGGGA

CGCGGGTTTCCTTATTGGGGCCAAGGGACTCTGGTCACTGTCTCTGCACATCATCACCATCACCAT

SEQ ID NO. 271

ATGCTCAGGCTGCTCTTGGCTCTCAACTTATTCCCTTCAATTCAAGTAACAGGAGACATCCAGATGACACAGACTACA

TCCTCCCTGTCTGCCTCTCTGGGAGACAGAGTCACCATCAGTTGCAGGGCAAGTCAGGACATTAGTAAATATTTAAAT

TGGTATCAGCAGAAACCAGATGGAACTGTTAAACTCCTGATCTACCATACATCAAGATTACACTCAGGAGTCCCATCA

AGGTTCAGTGGCAGTGGGTCTGGAACAGATTATTCTCTCACCATTAGCAACCTGGAGCAAGAAGATATTGCCACTTAC

TTTTGCCAACAGGGTAATACGCTTCCGTACACGTTCGGAGGGGGGACTAAGTTGGAAATAACAGGAGGAGGTGGGTCT

GGAGGTGGAGGATCTGGTGGAGGTGGGTCTGGAGGAGGTGGGTCTGAGGTGAAACTGCAGGAGTCAGGACCTGGCCTG

GTGGCGCCCTCACAGAGCCTGTCCGTCACATGCACTGTCTCAGGGGTCTCATTACCCGACTATGGTGTAAGCTGGATT

CGCCAGCCTCCACGAAAGGGTCTGGAGTGGCTGGGAGTAATATGGGGTAGTGAAACCACATACTATAATTCAGCTCTC

AAATCCAGACTGACCATCATCAAGGACAACTCCAAGAGCCAAGTTTTCTTAAAAATGAACAGTCTGCAAACTGATGAC

ACAGCCATTTACTACTGTGCCAAACATTATTACTACGGTGGTAGCTATGCTATGGACTACTGGGGTCAAGGAACCTCA

GTCACCGTCTCCTCAGACTACAAAGACGATGACGACAAGATTGAAGTTATGTATCCTCCTCCTTACCTAGACAATGAG

AAGAGCAATGGAACCATTATCCATGTGAAAGGGAAACACCTTTGTCCAAGTCCCTATTTCCCGGACCTTCTAAGCCC

TTTTGGGTGCTGGTGGTGGTTGGTGGAGTCCTGGCTTGCTATAGCTTGCTAGTAACAGTGGCCTTTATTATTTTCTGG

GTGAGGAGTAAGAGGAGCAGGCTCCTGCACAGTGACTACATGAACATGACTCCCCGCCGCCCCGGGCCCACCCGCAAG

CATTACCAGCCCTATGCCCCACCACGCGACTTCGCAGCCTATCGCTCCAAACGGGGCAGAAAGAAACTCCTGTATATA

TTCAAACAACCATTTATGAGACCAGTACAAACTACTCAAGAGGAAGATGGCTGTAGCTGCCGATTTCCAGAAGAAGAA

GAAGGAGGATGTGAACTGAGAGTGAAGTTCAGCAGGAGCGCAGACGCCCCCGCGTACCAGCAGGGCCAGAACCAGCTC

TATAACGAGCTCAATCTAGGACGAAGAGAGGAGTACGATGTTTTGGACAAGAGACGTGGCCGGGACCCTGAGATGGGG

```
GGAAAGCCGCAGAGAAGGAAGAACCCTCAGGAAGGCCTGTACAATGAACTGCAGAAAGATAAGATGGCGGAGGCCTAC

AGTGAGATTGGGATGAAAGGCGAGCGCCGAGGGGCAAGGGCACGATGGCCTTTACCAGGGTCTCAGTACAGCCACC

AAGGACACCTACGACGCCCTTCACATGCAGGCCCTGCCCCCTCGC
```

SEQ ID NO. 272
```
ATGCTCAGGCTGCTCTTGGCTCTCAACTTATTCCCTTCAATTCAAGTAACAGGAGACATCCAGATGACACAGACTACA

TCCTCCCTGTCTGCCTCTCTGGGAGACAGAGTCACCATCAGTTGCAGGGCAAGTCAGGACATTAGTAAATATTTAAAT

TGGTATCAGCAGAAACCAGATGGAACTGTTAAACTCCTGATCTACCATACATCAAGATTACACTCAGGAGTCCCATCA

AGGTTCAGTGGCAGTGGGTCTGGAACAGATTATTCTCTCACCATTAGCAACCTGGAGCAAGAAGATATTGCCACTTAC

TTTTGCCAACAGGGTAATACGCTTCCGTACACGTTCGGAGGGGGGACTAAGTTGGAAATAACAGGAGGAGGTGGGTCT

GGAGGTGGAGGATCTGGTGGAGGTGGGTCTGGAGGAGGTGGGTCTGAGGTGAAACTGCAGGAGTCAGGACCTGGCCTG

GTGGCGCCCTCACAGAGCCTGTCCGTCACATGCACTGTCTCAGGGGTCTCATTACCCGACTATGGTGTAAGCTGGATT

CGCCAGCCTCCACGAAAGGGTCTGGAGTGGCTGGGAGTAATATGGGGTAGTGAAACCACATACTATAATTCAGCTCTC

AAATCCAGACTGACCATCATCAAGGACAACTCCAAGAGCCAAGTTTTCTTAAAAATGAACAGTCTGCAAACTGATGAC

ACAGCCATTTACTACTGTGCCAAACATTATTACTACGGTGGTAGCTATGCTATGGACTACTGGGGTCAAGGAACCTCA

GTCACCGTCTCCTCAGACTACAAAGACGATGACGACAAGATTGAAGTTATGTATCCTCCTCCTTACCTGACAATGAG

AAGAGCAATGGAACCATTATCCATGTGAAAGGGAAACACCTTTGTCCAAGTCCCTATTTCCCGGACCTTCTAAGCCC

TTTTGGGTGCTGGTGGTGGTTGGTGGAGTCCTGGCTTGCTATAGCTTGCTAGTAACAGTGGCCTTTATTATTTTCTGG

GTGAGGAGTAAGAGGAGCAGGCTCCTGCACAGTGACTACATGAACATGACTCCCCGCCGCCCCGGGCCCACCCGCAAG

CATTACCAGCCCTATGCCCCACCACGCGACTTCGCAGCCTATCGCTCCAAACGGGGCAGAAAGAAACTCCTGTATATA

TTCAAACAACCATTTATGAGACCAGTACAAACTACTCAAGAGGAAGATGGCTGTAGCTGCCGATTTCCAGAAGAAGAA

GAAGGAGGATGTGAACTGAGAGTGAAGTTCAGCAGGAGCGCAGACGCCCCCGCGTACCAGCAGGGCCAGAACCAGCTC

TATAACGAGCTCAATCTAGGACGAAGAGAGGAGTACGATGTTTTGGACAAGAGACGTGGCCGGGACCCTGAGATGGGG

GGAAAGCCGCAGAGAAGGAAGAACCCTCAGGAAGGCCTGTACAATGAACTGCAGAAAGATAAGATGGCGGAGGCCTAC

AGTGAGATTGGGATGAAAGGCGAGCGCCGAGGGGCAAGGGCACGATGGCCTTTACCAGGGTCTCAGTACAGCCACC

AAGGACACCTACGACGCCCTTCACATGCAGGCCCTGCCCCCTCGC
```

SEQ ID NO. 273
```
TATTAATAGTAATCAATTACGGGGTCATTAGTTCATAGCCCATATATGGAGTTCCGCGTTACATAACTTACGGTAAAT

GGCCCGCCTGGCTGACCGCCCAACGACCCCCGCCCATTGACGTCAATAATGACGTATGTTCCCATAGTAACGCCAATA

GGGACTTTCCATTGACGTCAATGGGTGGAGTATTTACGGTAAACTGCCCACTTGGCAGTACATCAAGTGTATCATATG

CCAAGTACGCCCCCTATTGACGTCAATGACGGTAAATGGCCCGCCTGGCATTATGCCCAGTACATGACCTTATGGGAC

TTTCCTACTTGGCAGTACATCTACGTATTAGTCATCGCTATTACCATGGTGATGCGGTTTTGGCAGTACATCAATGGG

CGTGGATAGCGGTTTGACTCACGGGGATTTCCAAGTCTCCACCCCATTGACGTCAATGGGAGTTTGTTTTGGCACCAA

AATCAACGGGACTTTCCAAAATGTCGTAACAACTCCGCCCCATTGACGCAAATGGGCGGTAGGCGTGTACGGTGGGAG

GTCTATATAAGCAGAGCTCGCGGCCGCGCCACCATGCCACCTCCTCGCCTCCTCTTCTTCCTCCTCTTCCTCACCCCC

ATGGAAGTCAGGCCCGAGGAACCTCTAGTGGTGAAGGTGGAAGAGGGAGATAACGCTGTGCTGCAGTGCCTCAAGGGG

ACCTCAGATGGCCCCACTCAGCAGCTGACTTGGTCTCGGGAGTCCCCGCTTAAACCCTTCTTAAAACTCAGCCTGGGG

CTGCCAGGCCTGGGAATCCACATGAGGCCCCTGGCCATCTGGCTTTTCATCTTCAACGTCTCTCAACAGATGGGGGGC

TTCTACCTGTGCCAGCCGGGGCCCCCCTCTGAGAAGGCCTGGCAGCCTGGCTGGACAGTCAATGTGGAGGGCAGCGGG

GAGCTGTTCCGGTGGAATGTTTCGGACCTAGGTGGCCTGGGCTGTGGCCTGAAGAACAGGTCCTCAGAGGGCCCCAGC

TCCCCTTCCGGGAAGCTCATGAGCCCCAAGCTGTATGTGTGGGCCAAAGACCGCCCTGAGATCTGGGAGGGAGAGCCT

CCGTGTCTCCCACCGAGGGACAGCCTGAACCAGAGCCTCAGCCAGGACCTCACCATGGCCCCTGGCTCCACACTCTGG
```

-continued

CTGTCCTGTGGGGTACCCCCTGACTCTGTGTCCAGGGGCCCCCTCTCCTGGACCCATGTGCACCCCAAGGGGCCTAAG
TCATTGCTGAGCCTAGAGCTGAAGGACGATCGCCCGGCCAGAGATATGTGGGTAATGGAGACGGGTCTGTTGTTGCCC
CGGGCCACAGCTCAAGACGCTGGAAAGTATTATTGTCACCGTGGCAACCTGACCATGTCATTCCACCTGGAGATCACT
GCTCGGCCAGGGGAGGTGGGTCTGGAGGTGGAGGATCTGGTGGAGGTGGGTCTGGTGGAGGTGGGTCTGAGGTGCAG
CTGGTGGAGTCTGGTGGTGGTCTTGTTCAACCCGGTGGTTCTCTTCGTCTTTCTTGTGCTGCTTCTGGTTTTAATATT
AAAGATACTTATATTCATTGGGTTCGTCAAGCTCCTGGTAAAGGTCTTGAATGGGTTGCTCGTATTTATCCTACTAAT
GGTTATACTCGTTATGCTGATTCTGTTAAAGGTCGTTTTACTATTTCTGCTGATACTTCTAAAAATACTGCTTATCTT
CAAATGAACTCTCTTCGTGCTGAAGATACTGCTGTTTATTATTGTTCTCGTTGGGGTGGTGATGGTTTTTATGCTATG
GATTATTGGGGTCAAGGTACTCTTGTCACCGTCTCCTCAGCTAGCACCGGGGGAGGTGGGTCTGGAGGTGGAGGATCT
GGTGGAGGTGGGTCTGACATCCAGATGACCCAGTCTCCTTCTTCTCTTTCTGCTTCTGTTGGTGATCGTGTTACTATT
ACTTGTCGTGCTTCTCAAGATGTTAATACTGCTGTTGCTTGGTATCAACAAAAACCCGGTAAAGCTCCTAAACTTCTT
ATTTATTCTGCTTCTTTTCTTTATTCTGGTGTTCCTTCTCGTTTTTCTGGTTCTCGTTCTGGTACTGATTTTACTCTT
ACTATTTCTTCTCTTCAACCTGAAGATTTTGCTACTTATTATTGTCAACAACATTATACTACTCCTCCTACTTTTGGT
CAAGGTACCAAGGTGGAGATCAAACGTACGCATCATCACCATCACCAT

SEQ ID NO. 274
GGGAGAAGCTAGACTTAAAATCTTCCATTGCAGCTGTAAACACATCTGGACAATAGTCTGTTTTCTGCATTTGTGAAT
CCCACACCCATGGAACTATGAATCGTGCATCAGAGTTATTTAAAACCACCGTGCATGGAGTGAACCAATACCGAGGTG
TTTGCTTATCATTTTCCTTTGAGCACACAGCACAGCCTTGAACTCAGTGACACTCCTAAGAGGGCTCTAGGGTCAGGC
CAACTTAGATGAGATGCTAGTCTTTAGCTAAAGATGCCCTTCCACCCCCGTTGCACGACCTTGCTTCTCAGTCTTTGT
TGAGTCTTCTGGGGAGAATCCCCCTAGAGGACTCAGTTTACAAAACCCTAAGTGAGACCACTGCCAAGAAGTGCTTG
CTCACCCCTCCTGCCGCGGCAGGGAATCCCCCTTTCCTTGTACAGGCAAAACACAAAAAAGGACTCATAAGTGAAGCC
TGATCCTTCTCACCAAACACTGCCCACACCTCCTAGTAATTGAACTTGAAAAAAAAAACTGGTTTGAAAAATTACCGC
AAACCATATTGTCATAAAAAAAAAAAAAAACACTTCCTATATGAGATCACAGAACAGAGTAGGCACAAGTTCCTGCTG
AGCAGATCAGCCTAATGCTTAAATAGAACAACTCCTGGCTGTCATTGACATTGTCTAAAAGCCAAGATGACAGACTGA
GAGGCCTGAGCCCTTGTTCTGGCATTCTCCCAGGAAGATGCAGTAAAGGGGTTGACCCAATATACGCGGCCGCGCCAC
CATGCCACCTCCTCGCCTCCTCTTCTTCCTCCTCTTCCTCACCCCCATGGAAGTCAGGCCCGAGGAACCTCTAGTGGT
GAAGGTGGAAGAGGGAGATAACGCTGTGCTGCAGTGCCTCAAGGGGACCTCAGATGGCCCCACTCAGCAGCTGACTTG
GTCTCGGGAGTCCCCGCTTAAACCCTTCTTAAAACTCAGCCTGGGGCTGCCAGGCCTGGAATCCACATGAGGCCCCT
GGCCATCTGGCTTTTCATCTTCAACGTCTCTCAACAGATGGGGGCTTCTACCTGTGCCAGCCGGGGCCCCCCTCTGA
GAAGGCCTGGCAGCCTGGCTGGACAGTCAATGTGGAGGGCAGCGGGGAGCTGTTCCGGTGGAATGTTTCGGACCTAGG
TGGCCTGGGCTGTGGCCTGAAGAACAGGTCCTCAGAGGGCCCCAGCTCCCCTTCCGGGAAGCTCATGAGCCCCAAGCT
GTATGTGTGGGCCAAAGACCGCCCTGAGATCTGGGAGGGAGAGCCTCCGTGTCTCCCACCGAGGGACAGCCTGAACCA
GAGCCTCAGCCAGGACCTCACCATGGCCCCTGGCTCCACACTCTGGCTGTCCTGTGGGGTACCCCCTGACTCTGTGTC
CAGGGGCCCCCTCTCCTGGACCCATGTGCACCCCAAGGGGCCTAAGTCATTGCTGAGCCTAGAGCTGAAGGACGATCG
CCCGGCCAGAGATATGTGGGTAATGGAGACGGGTCTGTTGTTGCCCCGGGCCACAGCTCAAGACGCTGGAAAGTATTA
TTGTCACCGTGGCAACCTGACCATGTCATTCCACCTGGAGATCACTGCTCGGCCAGGGGAGGTGGGTCTGGAGGTGG
AGGATCTGGTGGAGGTGGGTCTGGTGGAGGTGGGTCTGAGGTGCAGCTGGTGGAGTCTGGTGGTGGTCTTGTTCAACC
CGGTGGTTCTCTTCGTCTTTCTTGTGCTGCTTCTGGTTTTAATATTAAAGATACTTATATTCATTGGGTTCGTCAAGC
TCCTGGTAAAGGTCTTGAATGGGTTGCTCGTATTTATCCTACTAATGGTTATACTCGTTATGCTGATTCTGTTAAAGG
TCGTTTTACTATTTCTGCTGATACTTCTAAAAATACTGCTTATCTTCAAATGAACTCTCTTCGTGCTGAAGATACTGC
TGTTTATTATTGTTCTCGTTGGGGTGGTGATGGTTTTTATGCTATGGATTATTGGGGTCAAGGTACTCTTGTCACCGT

```
CTCCTCAGCTAGCACCGGGGGAGGTGGGTCTGGAGGTGGAGGATCTGGTGGAGGTGGGTCTGACATCCAGATGACCCA
GTCTCCTTCTTCTCTTTCTGCTTCTGTTGGTGATCGTGTTACTATTACTTGTCGTGCTTCTCAAGATGTTAATACTGC
TGTTGCTTGGTATCAACAAAAACCCGGTAAAGCTCCTAAACTTCTTATTTATTCTGCTTCTTTTCTTTATTCTGGTGT
TCCTTCTCGTTTTTCTGGTTCTCGTTCTGGTACTGATTTTACTCTTACTATTTCTTCTCTTCAACCTGAAGATTTTGC
TACTTATTATTGTCAACAACATTATACTACTCCTCCTACTTTTGGTCAAGGTACCAAGGTGGAGATCAAACGTACGCA
TCATCACCATCACCAT
```

SEQ ID NO. 275
```
AATTTAAGGCAGGATGTCTCAGAGTCTGGGAAAATCCCACTTTCCTCCTGCTACACCTTACAGTTGTGAGAAAGCACA
TTTCAGACAACAGGGAAAACCCATACTTCACCACAACAACACACTATACATTGTCTGGTCCACTGGAGCATAAATTAA
AGAGAAACAATGTAGTCAAGCAAGTAGGCGGCAAGAGGAAGGGGCGGAGACATCATCAGGGAGTATAAACTCTGAGA
TGCCTCAGAGCCTCACAGACTCAACAAGAGCTCCAGCAAAGACTTTCACTGTAGCTTGACTTGACCTGAGATTAACTA
GGGAATCTTGAGAATAAAGGCGGCCGCGCCACCATGCCACCTCCTCGCCTCCTCTTCTTCCTCCTCTTCCTCACCCCC
ATGGAAGTCAGGCCCGAGGAACCTCTAGTGGTGAAGGTGGAAGAGGGAGATAACGCTGTGCTGCAGTGCCTCAAGGGG
ACCTCAGATGGCCCCACTCAGCAGCTGACTTGGTCTCGGGAGTCCCCGCTTAAACCCTTCTTAAAACTCAGCCTGGGG
CTGCCAGGCCTGGGAATCCACATGAGGCCCCTGGCCATCTGGCTTTTCATCTTCAACGTCTCTCAACAGATGGGGGGC
TTCTACCTGTGCCAGCCGGGGCCCCCCTCTGAGAAGGCCTGGCAGCCTGGCTGGACAGTCAATGTGGAGGGCAGCGGG
GAGCTGTTCCGGTGGAATGTTTCGGACCTAGGTGGCCTGGGCTGTGGCCTGAAGAACAGGTCCTCAGAGGGCCCCAGC
TCCCCTTCCGGGAAGCTCATGAGCCCCAAGCTGTATGTGTGGGCCAAAGACCGCCCTGAGATCTGGGAGGGAGAGCCT
CCGTGTCTCCCACCGAGGGACAGCCTGAACCAGAGCCTCAGCCAGGACCTCACCATGGCCCCTGGCTCCACACTCTGG
CTGTCCTGTGGGGTACCCCCTGACTCTGTGTCCAGGGGCCCCCTCTCCTGGACCCATGTGCACCCCAAGGGGCCTAAG
TCATTGCTGAGCCTAGAGCTGAAGGACGATCGCCCGGCCAGAGATATGTGGGTAATGGAGACGGGTCTGTTGTTGCCC
CGGGCCACAGCTCAAGACGCTGGAAAGTATTATTGTCACCGTGGCAACCTGACCATGTCATTCCACCTGGAGATCACT
GCTCGGCCAGGGGGAGGTGGGTCTGGAGGTGGAGGATCTGGTGGAGGTGGGTCTGGTGGAGGTGGGTCTGAGGTGCAG
CTGGTGGAGTCTGGTGGTGGTCTTGTTCAACCCGGTGGTTCTCTTCGTCTTTCTTGTGCTGCTTCTGGTTTTAATATT
AAAGATACTTATATTCATTGGGTTCGTCAAGCTCCTGGTAAAGGTCTTGAATGGGTTGCTCGTATTTATCCTACTAAT
GGTTATACTCGTTATGCTGATTCTGTTAAAGGTCGTTTTACTATTTCTGCTGATACTTCTAAAAATACTGCTTATCTT
CAAATGAACTCTCTTCGTGCTGAAGATACTGCTGTTTATTATTGTTCTCGTTGGGGTGGTGATGGTTTTTATGCTATG
GATTATTGGGGTCAAGGTACTCTTGTCACCGTCTCCTCAGCTAGCACCGGGGGAGGTGGGTCTGGAGGTGGAGGATCT
GGTGGAGGTGGGTCTGACATCCAGATGACCCAGTCTCCTTCTTCTCTTTCTGCTTCTGTTGGTGATCGTGTTACTATT
ACTTGTCGTGCTTCTCAAGATGTTAATACTGCTGTTGCTTGGTATCAACAAAAACCCGGTAAAGCTCCTAAACTTCTT
ATTTATTCTGCTTCTTTTCTTTATTCTGGTGTTCCTTCTCGTTTTTCTGGTTCTCGTTCTGGTACTGATTTTACTCTT
ACTATTTCTTCTCTTCAACCTGAAGATTTTGCTACTTATTATTGTCAACAACATTATACTACTCCTCCTACTTTTGGT
CAAGGTACCAAGGTGGAGATCAAACGTACGCATCATCACCATCACCAT
```

SEQ ID NO. 276
```
TAACGAAGACAGGGCCATGTAGAGGGCCCCAGGGAGTGAAAGGGCCTCCAGGACCTCCAGGTATGGAATACAGGGGAC
GTTTAAGAAGATATGGCCACACACTGGGGCCCTGAGAAGTGAGAGCTTCATGAAAAAAATCAGGGACCCCAGAGTTCC
TTGGAAGCCAAGACTGAAACCAGCATTATGAGTCTCCGGGTCAGAATGAAAGAAGAAGGCCTGCCCCAGTGGGGTCTG
TGAATTCCCGGGGGTGATTTCACTCCCCGGGGCTGTCCCAGGCTTGTCCCTGCTACCCCCACCCAGCCTTTCCTGAGG
CCTCAAGCCTGCCACCAAGCCCCCAGCTCCTTCTCCCCGCAGGGACCCAAACACAGGCCTCGGGACTCAACACAGCTT
TTCCCTCCAACCCCGTTTTCTCTCCCTCAAGGACTCAGCTTTCTGAGGCCCCTCCCAGTTCTAGTTCTATCTTTTTCC
TGCATCCTGTCTGGAAGTTAGAAGGAAACAGACCACAGACCCGGTCCCCAAAAGAAATGGAGGCAATAGGTTTTGAGG
GGCATGGGGACGGGGTTCAGCCTCCAGGGTCCTACACACAAATCAGTCAGTGGCCCAGAAGACCCCCTCGGAATCGGA
```

```
GCAGGGAGGATGGGGAGTGTGAGGGGTATCCTTGATGCTTGTGTGTCCCCAACTTTCCAAATCCCCGCCCCCGCGATG
GAGAAGAAACCGAGACAGAAGGTGCAGGGCCCACTACCGCTTCCTCCAGATGAGCTCATGGGTTTCTCCACCAAGGAA
GTTTTCCGCTGGTTGAATGATTCTTTCCCCGCCCTCCTCTCGCCCCAGGGACATATAAAGGCAGTTGTTGGCACACCC
AGCCAGCAGACGCTCCCTCAGCAAGGACAGCAGAGGACCAGCTAAGAGGGAGAGAAGCAACTACAGACCCCCCCTGAA
AACAACCCTCAGACGCCACATCCCCTGACAAGCTGCCAGGCAGGTTCTCTTCCTCTCACATACTGACCCACGGCTCCA
CCCTCTCTCCCCTGGAAAGGACACGCGGCCGCGCCACCATGCCACCTCCTCGCCTCCTCTTCTTCCTCCTCTTCCTCA
CCCCCATGGAAGTCAGGCCCGAGGAACCTCTAGTGGTGAAGGTGGAAGAGGGAGATAACGCTGTGCTGCAGTGCCTCA
AGGGGACCTCAGATGGCCCCACTCAGCAGCTGACTTGGTCTCGGGAGTCCCCGCTTAAACCCTTCTTAAAACTCAGCC
TGGGGCTGCCAGGCCTGGGAATCCACATGAGGCCCCTGGCCATCTGGCTTTTCATCTTCAACGTCTCTCAACAGATGG
GGGGCTTCTACCTGTGCCAGCCGGGGCCCCCCTCTGAGAAGGCCTGGCAGCCTGGCTGGACAGTCAATGTGGAGGGCA
GCGGGGAGCTGTTCCGGTGGAATGTTTCGGACCTAGGTGGCCTGGGCTGTGGCCTGAAGAACAGGTCCTCAGAGGGCC
CCAGCTCCCCTTCCGGGAAGCTCATGAGCCCCAAGCTGTATGTGTGGGCCAAAGACCGCCCTGAGATCTGGGAGGGAG
AGCCTCCGTGTCTCCCACCGAGGGACAGCCTGAACCAGAGCCTCAGCCAGGACCTCACCATGGCCCCTGGCTCCACAC
TCTGGCTGTCCTGTGGGGTACCCCCTGACTCTGTGTCCAGGGGCCCCCTCTCCTGGACCCATGTGCACCCCAAGGGGC
CTAAGTCATTGCTGAGCCTAGAGCTGAAGGACGATCGCCCGGCCAGAGATATGTGGGTAATGGAGACGGGTCTGTTGT
TGCCCCGGGCCACAGCTCAAGACGCTGGAAAGTATTATTGTCACCGTGGCAACCTGACCATGTCATTCCACCTGGAGA
TCACTGCTCGGCCAGGGGGAGGTGGGTCTGGAGGTGGAGGATCTGGTGGAGGTGGGTCTGGTGGAGGTGGGTCTGAGG
TGCAGCTGGTGGAGTCTGGTGGTGGTCTTGTTCAACCCGGTGGTTCTCTTCGTCTTTCTTGTGCTGCTTCTGGTTTTA
ATATTAAAGATACTTATATTCATTGGGTTCGTCAAGCTCCTGGTAAAGGTCTTGAATGGGTTGCTCGTATTTATCCTA
CTAATGGTTATACTCGTTATGCTGATTCTGTTAAAGGTCGTTTTACTATTTCTGCTGATACTTCTAAAAATACTGCTT
ATCTTCAAATGAACTCTCTTCGTGCTGAAGATACTGCTGTTTATTATTGTTCTCGTTGGGGTGGTGATGGTTTTTATG
CTATGGATTATTGGGGTCAAGGTACTCTTGTCACCGTCTCCTCAGCTAGCACCGGGGGAGGTGGGTCTGGAGGTGGAG
GATCTGGTGGAGGTGGGTCTGACATCCAGATGACCCAGTCTCCTTCTTCTCTTTCTGCTTCTGTTGGTGATCGTGTTA
CTATTACTTGTCGTGCTTCTCAAGATGTTAATACTGCTGTTGCTTGGTATCAACAAAAACCCGGTAAAGCTCCTAAAC
TTCTTATTTATTCTGCTTCTTTTCTTTATTCTGGTGTTCCTTCTCGTTTTTCTGGTTCTCGTTCTGGTACTGATTTTA
CTCTTACTATTTCTTCTCTTCAACCTGAAGATTTTGCTACTTATTATTGTCAACAACATTATACTACTCCTCCTACTT
TTGGTCAAGGTACCAAGGTGGAGATCAAACGTACGCATCATCACCATCACCAT
```
SEQ ID NO. 277
```
GATATCGAATTAGGAGGAAAACTGTTTCATACAGAAGGCGTCAATTAGGAGGAAAAACTGTTTCATACAGAAGGCGTC
AATTAGGAGGAAAAACTGTTTCATACAGAAGGCGTCAATTGGTCCCATCGAATTAGGAGGAAAAACTGTTTCATACAG
AAGGCGTCAATTAGGAGGAAAAACTGTTTCATACAGAAGGCGTCAATTAGGAGGAAAAACTGTTTCATACAGAAGGCG
TCAATTGGTCCCGGGACATTTTGACACCCCCATAATATTTTTCCAGAATTAACAGTATAAATTGCATCTCTTGTTCAA
GAGTTCCCTATCACTCTCTTTAATCACTACTCACAGTAACCTCAACTCCTGGCGGCCGCGCCACCATGCCACCTCCTC
GCCTCCTCTTCTTCCTCCTCTTCCTCACCCCCATGGAAGTCAGGCCCGAGGAACCTCTAGTGGTGAAGGTGGAAGAGG
GAGATAACGCTGTGCTGCAGTGCCTCAAGGGGACCTCAGATGGCCCCACTCAGCAGCTGACTTGGTCTCGGGAGTCCC
CGCTTAAACCCTTCTTAAAACTCAGCCTGGGGCTGCCAGGCCTGGGAATCCACATGAGGCCCCTGGCCATCTGGCTTT
TCATCTTCAACGTCTCTCAACAGATGGGGGGCTTCTACCTGTGCCAGCCGGGGCCCCCCTCTGAGAAGGCCTGGCAGC
CTGGCTGGACAGTCAATGTGGAGGGCAGCGGGGAGCTGTTCCGGTGGAATGTTTCGGACCTAGGTGGCCTGGGCTGTG
GCCTGAAGAACAGGTCCTCAGAGGGCCCCAGCTCCCCTTCCGGGAAGCTCATGAGCCCCAAGCTGTATGTGTGGGCCA
AAGACCGCCCTGAGATCTGGGAGGGAGAGCCTCCGTGTCTCCCACCGAGGGACAGCCTGAACCAGAGCCTCAGCCAGG
ACCTCACCATGGCCCCTGGCTCCACACTCTGGCTGTCCTGTGGGGTACCCCCTGACTCTGTGTCCAGGGGCCCCCTCT
```

```
CCTGGACCCATGTGCACCCCAAGGGGCCTAAGTCATTGCTGAGCCTAGAGCTGAAGGACGATCGCCCGGCCAGAGATA
TGTGGGTAATGGAGACGGGTCTGTTGTTGCCCCGGGCCACAGCTCAAGACGCTGGAAAGTATTATTGTCACCGTGGCA
ACCTGACCATGTCATTCCACCTGGAGATCACTGCTCGGCCAGGGGGAGGTGGGTCTGGAGGTGGAGGATCTGGTGGAG
GTGGGTCTGGTGGAGGTGGGTCTGAGGTGCAGCTGGTGGAGTCTGGTGGTGGTCTTGTTCAACCCGGTGGTTCTCTTC
GTCTTTCTTGTGCTGCTTCTGGTTTTAATATTAAAGATACTTATATTCATTGGGTTCGTCAAGCTCCTGGTAAAGGTC
TTGAATGGGTTGCTCGTATTTATCCTACTAATGGTTATACTCGTTATGCTGATTCTGTTAAAGGTCGTTTTACTATTT
CTGCTGATACTTCTAAAAATACTGCTTATCTTCAAATGAACTCTCTTCGTGCTGAAGATACTGCTGTTTATTATTGTT
CTCGTTGGGGTGGTGATGGTTTTTATGCTATGGATTATTGGGGTCAAGGTACTCTTGTCACCGTCTCCTCAGCTAGCA
CCGGGGGAGGTGGGTCTGGAGGTGGAGGATCTGGTGGAGGTGGGTCTGACATCCAGATGACCCAGTCTCCTTCTTCTC
TTTCTGCTTCTGTTGGTGATCGTGTTACTATTACTTGTCGTGCTTCTCAAGATGTTAATACTGCTGTTGCTTGGTATC
AACAAAAACCCGGTAAAGCTCCTAAACTTCTTATTTATTCTGCTTCTTTTCTTTATTCTGGTGTTCCTTCTCGTTTTT
CTGGTTCTCGTTCTGGTACTGATTTTACTCTTACTATTTCTTCTCTTCAACCTGAAGATTTTGCTACTTATTATTGTC
AACAACATTATACTACTCCTCCTACTTTTGGTCAAGGTACCAAGGTGGAGATCAAACGTACGCATCATCACCATCACC
AT
                                                                SEQ ID NO. 278
ATGGATTTTCAGGTGCAGATTTTCAGCTTCCTGCTAATCAGTGCCTCAGTCATAATGTCTAGAATGGCCCAGGTCAAA
CTACAGGAGTCAGGGGCTGAGCTGGTGAAGCCTGGGGCCTCAGTGAAGATGTCCTGCAAGGCTTCTGGCTACACATTT
ACCAGTTACAATATGCACTGGGTAAAGCAGACACCTGGACAGGGCCTGGAATGGATTGGAGCTATTTATCCAGGAAAT
GGTGATACTTCCTACAATCAGAAGTTCAAAGGCAAGGCCACATTGACTGCAGACAAATCCTCCAGCACAGCCTACATG
CAGCTCAGCAGCCTGACATCTGAGGACTCTGCGGACTATTACTGTGCAAGATCTAATTATTACGGTAGTAGCTACTGG
TTCTTCGATGTCTGGGGCCAAGGGACCACGGTCACCGTCTCCTCAGGTGGAGGCGGTTCAGGCGGAGGTGGCTCTGGC
GGTGGCGGATCGGACATCGAGCTCACTCAGTCTCCAACAATCCTGTCTGCATCTCCAGGGGAGAAGGTCACAATGACT
TGCAGGGCCAGCTCAAGTGTAAATTACATGGACTGGTACCAGAAGAAGCCAGGATCCTCCCCCAAACCCTGGATTTAT
GCCACATCCAACCTGGCTTCTGGAGTCCCTGCTCGCTTCAGTGGCAGTGGGTCTGGGACCTCTTACTCTCTCACAATC
AGCAGAGTGGAGGCTGAAGATGCTGCCACTTATTACTGCCAGCAGTGGAGTTTTAATCCACCCACGTTCGGAGGGGGG
ACAAAGTTGGAAATAAAACGGGCCGCCGCTGGTGATCCCGCCGAGCCCAAATCTCCTGACAAAACTCACACATGCCCA
CCGTGCCCAGCACCTGAACTCCTGGGGGGACCGTCAGTCTTCCTCTTCCCCCCAAAACCCAAGGACACCCTCATGATC
TCCCGGACCCCTGAGGTCACATGCGTGGTGGTGGACGTGAGCCACGAAGACCCTGAGGTCAAGTTCAACTGGTACGTG
GACGGCGTGGAGGTGCATAATGCCAAGACAAAGCCGCGGGAGGAGCAGTACAACAGCACGTACCGTGTGGTCAGCGTC
CTCACCGTCCTGCACCAGGACTGGCTGAATGGCAAGGAGTACAAGTGCAAGGTCTCCAACAAAGCCCTCCCAGCCCCC
ATCGAGAAAACCATCTCCAAAGCCAAAGGGCAGCCCCGAGAACCACAGGTGTACACCCTGCCCCCATCCCGGGAGGAG
ATGACCAAGAACCAGGTCAGCCTGACCTGCCTGGTCAAAGGCTTCTATCCCAGCGACATCGCCGTGGAGTGGGAGAGC
AATGGGCAGCCGGAGAACAACTACAAGACCACGCCTCCCGTGCTGGACTCCGACGGCTCCTTCTTCCTCTACAGCAAG
CTCACCGTGGACAAGAGCAGGTGGCAGCAGGGGAACGTCTTCTCATGCTCCGTGATGCACGAGGCTCTGCACAACCAC
TACACGCAGAAGAGCCTCTCCCTGTCTCCGGGT
                                                                SEQ ID NO. 279
ATGGATTTTCAGGTGCAGATTTTCAGCTTCCTGCTAATCAGTGCCTCAGTCATAATGTCTAGAATGGCCCAGGTCAAA
CTACAGGAGTCAGGGGCTGAGCTGGTGAAGCCTGGGGCCTCAGTGAAGATGTCCTGCAAGGCTTCTGGCTACACATTT
ACCAGTTACAATATGCACTGGGTAAAGCAGACACCTGGACAGGGCCTGGAATGGATTGGAGCTATTTATCCAGGAAAT
GGTGATACTTCCTACAATCAGAAGTTCAAAGGCAAGGCCACATTGACTGCAGACAAATCCTCCAGCACAGCCTACATG
CAGCTCAGCAGCCTGACATCTGAGGACTCTGCGGACTATTACTGTGCAAGATCTAATTATTACGGTAGTAGCTACTGG
```

-continued

TTCTTCGATGTCTGGGGCCAAGGGACCACGGTCACCGTCTCCTCAGGTGGAGGCGGTTCAGGCGGAGGTGGCTCTGGC

GGTGGCGGATCGGACATCGAGCTCACTCAGTCTCCAACAATCCTGTCTGCATCTCCAGGGGAGAAGGTCACAATGACT

TGCAGGGCCAGCTCAAGTGTAAATTACATGGACTGGTACCAGAAGAAGCCAGGATCCTCCCCCAAACCCTGGATTTAT

GCCACATCCAACCTGGCTTCTGGAGTCCCTGCTCGCTTCAGTGGCAGTGGGTCTGGGACCTCTTACTCTCTCACAATC

AGCAGAGTGGAGGCTGAAGATGCTGCCACTTATTACTGCCAGCAGTGGAGTTTTAATCCACCCACGTTCGGAGGGGGG

ACAAAGTTGGAAATAAAACGGGCCGCCGCTCATCATCACCATCACCAT

SEQ ID NO. 280

ATGGATTTTCAGGTGCAGATTTTCAGCTTCCTGCTAATCAGTGCCTCAGTCATAATGTCTAGAGACATCGAGCTCACT

CAGTCTCCAACAATCCTGTCTGCATCTCCAGGGGAGAAGGTCACAATGACTTGCAGGGCCAGCTCAAGTGTAAATTAC

ATGGACTGGTACCAGAAGAAGCCAGGATCCTCCCCCAAACCCTGGATTTATGCCACATCCAACCTGGCTTCTGGAGTC

CCTGCTCGCTTCAGTGGCAGTGGGTCTGGGACCTCTTACTCTCTCACAATCAGCAGAGTGGAGGCTGAAGATGCTGCC

ACTTATTACTGCCAGCAGTGGAGTTTTAATCCACCCACGTTCGGAGGGGGGACAAAGTTGGAAATAAAACGGGGTGGA

GGCGGTTCAGGCGGAGGTGGCTCTGGCGGTGGCGGATCGATGGCCCAGGTCAAACTACAGGAGTCAGGGGCTGAGCTG

GTGAAGCCTGGGGCCTCAGTGAAGATGTCCTGCAAGGCTTCTGGCTACACATTTACCAGTTACAATATGCACTGGGTA

AAGCAGACACCTGGACAGGGCCTGGAATGGATTGGAGCTATTTATCCAGGAAATGGTGATACTTCCTACAATCAGAAG

TTCAAAGGCAAGGCCACATTGACTGCAGACAAATCCTCCAGCACAGCCTACATGCAGCTCAGCAGCCTGACATCTGAG

GACTCTGCGGACTATTACTGTGCAAGATCTAATTATTACGGTAGTAGCTACTGGTTCTTCGATGTCTGGGGCCAAGGG

ACCACGGTCACCGTCTCCTCAGCCGCCGCTGGTGATCCCGCCGAGCCCAAATCTCCTGACAAAACTCACACATGCCCA

CCGTGCCCAGCACCTGAACTCCTGGGGGGACCGTCAGTCTTCCTCTTCCCCCCAAAACCCAAGGACACCCTCATGATC

TCCCGGACCCCTGAGGTCACATGCGTGGTGGTGGACGTGAGCCACGAAGACCCTGAGGTCAAGTTCAACTGGTACGTG

GACGGCGTGGAGGTGCATAATGCCAAGACAAAGCCGCGGGAGGAGCAGTACAACAGCACGTACCGTGTGGTCAGCGTC

CTCACCGTCCTGCACCAGGACTGGCTGAATGGCAAGGAGTACAAGTGCAAGGTCTCCAACAAAGCCCTCCCAGCCCCC

ATCGAGAAAACCATCTCCAAAGCCAAAGGGCAGCCCCGAGAACCACAGGTGTACACCCTGCCCCCATCCCGGGAGGAG

ATGACCAAGAACCAGGTCAGCCTGACCTGCCTGGTCAAAGGCTTCTATCCCAGCGACATCGCCGTGGAGTGGGAGAGC

AATGGGCAGCCGGAGAACAACTACAAGACCACGCCTCCCGTGCTGGACTCCGACGGCTCCTTCTTCCTCTACAGCAAG

CTCACCGTGGACAAGAGCAGGTGGCAGCAGGGGAACGTCTTCTCATGCTCCGTGATGCACGAGGCTCTGCACAACCAC

TACACGCAGAAGAGCCTCTCCCTGTCTCCGGGT

SEQ ID NO. 281

ATGGATTTTCAGGTGCAGATTTTCAGCTTCCTGCTAATCAGTGCCTCAGTCATAATGTCTAGAGACATCGAGCTCACT

CAGTCTCCAACAATCCTGTCTGCATCTCCAGGGGAGAAGGTCACAATGACTTGCAGGGCCAGCTCAAGTGTAAATTAC

ATGGACTGGTACCAGAAGAAGCCAGGATCCTCCCCCAAACCCTGGATTTATGCCACATCCAACCTGGCTTCTGGAGTC

CCTGCTCGCTTCAGTGGCAGTGGGTCTGGGACCTCTTACTCTCTCACAATCAGCAGAGTGGAGGCTGAAGATGCTGCC

ACTTATTACTGCCAGCAGTGGAGTTTTAATCCACCCACGTTCGGAGGGGGGACAAAGTTGGAAATAAAACGGGGTGGA

GGCGGTTCAGGCGGAGGTGGCTCTGGCGGTGGCGGATCGATGGCCCAGGTCAAACTACAGGAGTCAGGGGCTGAGCTG

GTGAAGCCTGGGGCCTCAGTGAAGATGTCCTGCAAGGCTTCTGGCTACACATTTACCAGTTACAATATGCACTGGGTA

AAGCAGACACCTGGACAGGGCCTGGAATGGATTGGAGCTATTTATCCAGGAAATGGTGATACTTCCTACAATCAGAAG

TTCAAAGGCAAGGCCACATTGACTGCAGACAAATCCTCCAGCACAGCCTACATGCAGCTCAGCAGCCTGACATCTGAG

GACTCTGCGGACTATTACTGTGCAAGATCTAATTATTACGGTAGTAGCTACTGGTTCTTCGATGTCTGGGGCCAAGGG

ACCACGGTCACCGTCTCCTCAGCCGCCGCTCATCATCACCATCACCAT

SEQ ID NO. 282

ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

-continued

TCTCGGGAGTCCCCGCTTAAACCCTTCTTAAAACTCAGCCTGGGGCTGCCAGGCCTGGGAATCCACATGAGGCCCCTG
GCCATCTGGCTTTTCATCTTCAACGTCTCTCAACAGATGGGGGGCTTCTACCTGTGCCAGCCGGGGCCCCCCTCTGAG
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGACAGCCTGAACCAG
AGCCTCAGCCAGGACCTCACCATGGCCCCTGGCTCCACACTCTGGCTGTCCTGTGGGGTACCCCCTGACTCTGTGTCC
AGGGGCCCCCTCTCCTGGACCCATGTGCACCCCAAGGGGCCTAAGTCATTGCTGAGCCTAGAGCTGAAGGACGATCGC
CCGGCCAGAGATATGTGGGTAATGGAGACGGGTCTGTTGTTGCCCCGGGCCACAGCTCAAGACGCTGGAAAGTATTAT
TGTCACCGTGGCAACCTGACCATGTCATTCCACCTGGAGATCACTGCTCGGCCAGGAGGAGGTGGGTCTGGAGGTGGA
GGATCTGGTGGAGGTGGGTCTGGAGGAGGTGGGTCTATGGCCCAGGTCAAACTACAGGAGTCAGGGGCTGAGCTGGTG
AAGCCTGGGGCCTCAGTGAAGATGTCCTGCAAGGCTTCTGGCTACACATTTACCAGTTACAATATGCACTGGGTAAAG
CAGACACCTGGACAGGGCCTGGAATGGATTGGAGCTATTTATCCAGGAAATGGTGATACTTCCTACAATCAGAAGTTC
AAAGGCAAGGCCACATTGACTGCAGACAAATCCTCCAGCACAGCCTACATGCAGCTCAGCAGCCTGACATCTGAGGAC
TCTGCGGACTATTACTGTGCAAGATCTAATTATTACGGTAGTAGCTACTGGTTCTTCGATGTCTGGGGCCAAGGGACC
ACGGTCACCGTCTCCTCAGGTGGAGGCGGTTCAGGCGGAGGTGGCTCTGGCGGTGGCGGATCGGACATCGAGCTCACT
CAGTCTCCAACAATCCTGTCTGCATCTCCAGGGGAGAAGGTCACAATGACTTGCAGGGCCAGCTCAAGTGTAAATTAC
ATGGACTGGTACCAGAAGAAGCCAGGATCCTCCCCCAAACCCTGGATTTATGCCACATCCAACCTGGCTTCTGGAGTC
CCTGCTCGCTTCAGTGGCAGTGGGTCTGGGACCTCTTACTCTCTCACAATCAGCAGAGTGGAGGCTGAAGATGCTGCC
ACTTATTACTGCCAGCAGTGGAGTTTTAATCCACCCACGTTCGGAGGGGGGACAAAGTTGGAAATAAAACGGGCCGCC
GCTGGTGATCCCGCCGAGCCCAAATCTCCTGACAAAACTCACACATGCCCACCGTGCCCAGCACCTGAACTCCTGGGG
GGACCGTCAGTCTTCCTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGAGGTGCATAATGCCAAG
ACAAAGCCGCGGGAGGAGCAGTACAACAGCACGTACCGTGTGGTCAGCGTCCTCACCGTCCTGCACCAGGACTGGCTG
AATGGCAAGGAGTACAAGTGCAAGGTCTCCAACAAAGCCCTCCCAGCCCCCATCGAGAAAACCATCTCCAAAGCCAAA
GGGCAGCCCCGAGAACCACAGGTGTACACCCTGCCCCCATCCCGGGAGGAGATGACCAAGAACCAGGTCAGCCTGACC
TGCCTGGTCAAAGGCTTCTATCCCAGCGACATCGCCGTGGAGTGGGAGAGCAATGGGCAGCCGGAGAACAACTACAAG
ACCACGCCTCCCGTGCTGGACTCCGACGGCTCCTTCTTCCTCTACAGCAAGCTCACCGTGGACAAGAGCAGGTGGCAG
CAGGGGAACGTCTTCTCATGCTCCGTGATGCACGAGGCTCTGCACAACCACTACACGCAGAAGAGCCTCTCCCTGTCT
CCGGGT

SEQ ID NO. 283
ATGCCACCTCCTCGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCAGCAGCTGACCTGG
TCTCGGGAGTCCCCGCTTAAACCCTTCTTAAAACTCAGCCTGGGGCTGCCAGGCCTGGGAATCCACATGAGGCCCCTG
GCCATCTGGCTTTTCATCTTCAACGTCTCTCAACAGATGGGGGGCTTCTACCTGTGCCAGCCGGGGCCCCCCTCTGAG
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGACAGCCTGAACCAG
AGCCTCAGCCAGGACCTCACCATGGCCCCTGGCTCCACACTCTGGCTGTCCTGTGGGGTACCCCCTGACTCTGTGTCC
AGGGGCCCCCTCTCCTGGACCCATGTGCACCCCAAGGGGCCTAAGTCATTGCTGAGCCTAGAGCTGAAGGACGATCGC
CCGGCCAGAGATATGTGGGTAATGGAGACGGGTCTGTTGTTGCCCCGGGCCACAGCTCAAGACGCTGGAAAGTATTAT
TGTCACCGTGGCAACCTGACCATGTCATTCCACCTGGAGATCACTGCTCGGCCAGGAGGAGGTGGGTCTGGAGGTGGA

-continued

```
GGATCTGGTGGAGGTGGGTCTGGAGGAGGTGGGTCTATGGCCCAGGTCAAACTACAGGAGTCAGGGGCTGAGCTGGTG
AAGCCTGGGGCCTCAGTGAAGATGTCCTGCAAGGCTTCTGGCTACACATTTACCAGTTACAATATGCACTGGGTAAAG
CAGACACCTGGACAGGGCCTGGAATGGATTGGAGCTATTTATCCAGGAAATGGTGATACTTCCTACAATCAGAAGTTC
AAAGGCAAGGCCACATTGACTGCAGACAAATCCTCCAGCACAGCCTACATGCAGCTCAGCAGCCTGACATCTGAGGAC
TCTGCGGACTATTACTGTGCAAGATCTAATTATTACGGTAGTAGCTACTGGTTCTTCGATGTCTGGGGCCAAGGGACC
ACGGTCACCGTCTCCTCAGGTGGAGGCGGTTCAGGCGGAGGTGGCTCTGGCGGTGGCGGATCGGACATCGAGCTCACT
CAGTCTCCAACAATCCTGTCTGCATCTCCAGGGGAGAAGGTCACAATGACTTGCAGGGCCAGCTCAAGTGTAAATTAC
ATGGACTGGTACCAGAAGAAGCCAGGATCCTCCCCCAAACCCTGGATTTATGCCACATCCAACCTGGCTTCTGGAGTC
CCTGCTCGCTTCAGTGGCAGTGGGTCTGGGACCTCTTACTCTCTCACAATCAGCAGAGTGGAGGCTGAAGATGCTGCC
ACTTATTACTGCCAGCAGTGGAGTTTTAATCCACCCACGTTCGGAGGGGGGACAAAGTTGGAAATAAAACGGGCCGCC
GCTCATCATCACCATCACCAT
```

SEQ ID NO. 284
```
ATGCCACCTCCTCGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCAGCAGCTGACCTGG
TCTCGGGAGTCCCCGCTTAAACCCTTCTTAAAACTCAGCCTGGGGCTGCCAGGCCTGGGAATCCACATGAGGCCCCTG
GCCATCTGGCTTTTCATCTTCAACGTCTCTCAACAGATGGGGGGCTTCTACCTGTGCCAGCCGGGGCCCCCCTCTGAG
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGACAGCCTGAACCAG
AGCCTCAGCCAGGACCTCACCATGGCCCCTGGCTCCACACTCTGGCTGTCCTGTGGGGTACCCCCTGACTCTGTGTCC
AGGGGCCCCCTCTCCTGGACCCATGTGCACCCCAAGGGGCCTAAGTCATTGCTGAGCCTAGAGCTGAAGGACGATCGC
CCGGCCAGAGATATGTGGGTAATGGAGACGGGTCTGTTGTTGCCCCGGGCCACAGCTCAAGACGCTGGAAAGTATTAT
TGTCACCGTGGCAACCTGACCATGTCATTCCACCTGGAGATCACTGCTCGGCCAGGAGGAGGTGGGTCTGGAGGTGGA
GGATCTGGTGGAGGTGGGTCTGGAGGAGGTGGGTCTGACATCGAGCTCACTCAGTCTCCAACAATCCTGTCTGCATCT
CCAGGGGAGAAGGTCACAATGACTTGCAGGGCCAGCTCAAGTGTAAATTACATGGACTGGTACCAGAAGAAGCCAGGA
TCCTCCCCCAAACCCTGGATTTATGCCACATCCAACCTGGCTTCTGGAGTCCCTGCTCGCTTCAGTGGCAGTGGGTCT
GGGACCTCTTACTCTCTCACAATCAGCAGAGTGGAGGCTGAAGATGCTGCCACTTATTACTGCCAGCAGTGGAGTTTT
AATCCACCCACGTTCGGAGGGGGGACAAAGTTGGAAATAAAACGGGGTGGAGGCGGTTCAGGCGGAGGTGGCTCTGGC
GGTGGCGGATCGATGGCCCAGGTCAAACTACAGGAGTCAGGGGCTGAGCTGGTGAAGCCTGGGGCCTCAGTGAAGATG
TCCTGCAAGGCTTCTGGCTACACATTTACCAGTTACAATATGCACTGGGTAAAGCAGACACCTGGACAGGGCCTGGAA
TGGATTGGAGCTATTTATCCAGGAAATGGTGATACTTCCTACAATCAGAAGTTCAAAGGCAAGGCCACATTGACTGCA
GACAAATCCTCCAGCACAGCCTACATGCAGCTCAGCAGCCTGACATCTGAGGACTCTGCGGACTATTACTGTGCAAGA
TCTAATTATTACGGTAGTAGCTACTGGTTCTTCGATGTCTGGGGCCAAGGGACCACGGTCACCGTCTCCTCAGCCGCC
GCTGGTGATCCCGCCGAGCCCAAATCTCCTGACAAAACTCACACATGCCCACCGTGCCCAGCACCTGAACTCCTGGGG
GGACCGTCAGTCTTCCTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGAGGTGCATAATGCCAAG
ACAAAGCCGCGGGAGGAGCAGTACAACAGCACGTACCGTGTGGTCAGCGTCCTCACCGTCCTGCACCAGGACTGGCTG
AATGGCAAGGAGTACAAGTGCAAGGTCTCCAACAAAGCCCTCCCAGCCCCCATCGAGAAAACCATCTCCAAAGCCAAA
GGGCAGCCCCGAGAACCACAGGTGTACACCCTGCCCCCATCCCGGGAGGAGATGACCAAGAACCAGGTCAGCCTGACC
TGCCTGGTCAAAGGCTTCTATCCCAGCGACATCGCCGTGGAGTGGGAGAGCAATGGGCAGCCGGAGAACAACTACAAG
ACCACGCCTCCCGTGCTGGACTCCGACGGCTCCTTCTTCCTCTACAGCAAGCTCACCGTGGACAAGAGCAGGTGGCAG
```

CAGGGGAACGTCTTCTCATGCTCCGTGATGCACGAGGCTCTGCACAACCACTACACGCAGAAGAGCCTCTCCCTGTCT

CCGGGT

SEQ ID NO. 285
ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

GCCATCTGGCTTTTCATCTTCAACGTCTCTCAACAGATGGGGGGCTTCTACCTGTGCCAGCCGGGGCCCCCCTCTGAG

AAGGCCTGGCAGCCTGGCTGGACAGTCAATGTGGAGGGCAGCGGGGAGCTGTTCCGGTGGAATGTTTCGGACCTAGGT

GGCCTGGGCTGTGGCCTGAAGAACAGGTCCTCAGAGGGCCCCAGCTCCCCTTCCGGGAAGCTCATGAGCCCCAAGCTG

TATGTGTGGGCCAAAGACCGCCCTGAGATCTGGGAGGGAGAGCCTCCGTGTCTCCCACCGAGGGACAGCCTGAACCAG

AGCCTCAGCCAGGACCTCACCATGGCCCCTGGCTCCACACTCTGGCTGTCCTGTGGGGTACCCCCTGACTCTGTGTCC

AGGGGCCCCCTCTCCTGGACCCATGTGCACCCCAAGGGGCCTAAGTCATTGCTGAGCCTAGAGCTGAAGGACGATCGC

CCCGGCCAGAGATATGTGGGTAATGGAGACGGGTCTGTTGTTGCCCCGGGCCACAGCTCAAGACGCTGGAAAGTATTAT

TGTCACCGTGGCAACCTGACCATGTCATTCCACCTGGAGATCACTGCTCGGCCAGGAGGAGGTGGGTCTGGAGGTGGA

GGATCTGGTGGAGGTGGGTCTGGAGGAGGTGGGTCTGACATCGAGCTCACTCAGTCTCCAACAATCCTGTCTGCATCT

CCAGGGGAGAAGGTCACAATGACTTGCAGGGCCAGCTCAAGTGTAAATTACATGGACTGGTACCAGAAGAAGCCAGGA

TCCTCCCCCAAACCCTGGATTTATGCCACATCCAACCTGGCTTCTGGAGTCCCTGCTCGCTTCAGTGGCAGTGGGTCT

GGGACCTCTTACTCTCTCACAATCAGCAGAGTGGAGGCTGAAGATGCTGCCACTTATTACTGCCAGCAGTGGAGTTTT

AATCCACCCACGTTCGGAGGGGGGACAAAGTTGGAAATAAAACGGGGTGGAGGCGGTTCAGGCGGAGGTGGCTCTGGC

GGTGGCGGATCGATGGCCCAGGTCAAACTACAGGAGTCAGGGGCTGAGCTGGTGAAGCCTGGGGCCTCAGTGAAGATG

TCCTGCAAGGCTTCTGGCTACACATTTACCAGTTACAATATGCACTGGGTAAAGCAGACACCTGGACAGGGCCTGGAA

TGGATTGGAGCTATTTATCCAGGAAATGGTGATACTTCCTACAATCAGAAGTTCAAAGGCAAGGCCACATTGACTGCA

GACAAATCCTCCAGCACAGCCTACATGCAGCTCAGCAGCCTGACATCTGAGGACTCTGCGGACTATTACTGTGCAAGA

TCTAATTATTACGGTAGTAGCTACTGGTTCTTCGATGTCTGGGGCCAAGGGACCACGGTCACCGTCTCCTCAGCCGCC

GCTCATCATCACCATCACCAT

SEQ ID NO. 286
ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

GCCATCTGGCTTTTCATCTTCAACGTCTCTCAACAGATGGGGGGCTTCTACCTGTGCCAGCCGGGGCCCCCCTCTGAG

AAGGCCTGGCAGCCTGGCTGGACAGTCAATGTGGAGGGCAGCGGGGAGCTGTTCCGGTGGAATGTTTCGGACCTAGGT

GGCCTGGGCTGTGGCCTGAAGAACAGGTCCTCAGAGGGCCCCAGCTCCCCTTCCGGGAAGCTCATGAGCCCCAAGCTG

TATGTGTGGGCCAAAGACCGCCCTGAGATCTGGGAGGGAGAGCCTCCGTGTCTCCCACCGAGGGACAGCCTGAACCAG

AGCCTCAGCCAGGACCTCACCATGGCCCCTGGCTCCACACTCTGGCTGTCCTGTGGGGTACCCCCTGACTCTGTGTCC

AGGGGCCCCCTCTCCTGGACCCATGTGCACCCCAAGGGGCCTAAGTCATTGCTGAGCCTAGAGCTGAAGGACGATCGC

CCCGGCCAGAGATATGTGGGTAATGGAGACGGGTCTGTTGTTGCCCCGGGCCACAGCTCAAGACGCTGGAAAGTATTAT

TGTCACCGTGGCAACCTGACCATGTCATTCCACCTGGAGATCACTGCTCGGCCAGGAGGAGGTGGGTCTGGAGGTGGA

GGATCTGGTGGAGGTGGGTCTGGAGGAGGTGGGTCTCAGGTGCAGCTGGTGCAGAGCGGCGCCGAGGACAAGAAGCCC

GGCGAGAGCGTGAAGATCAGCTGCAAGGCCAGCGGCTACACCTTCACCAACTACGGCATGAACTGGGTGAGGCAGGCC

CCCGGCCAGGGCCTGAAGTGGATGGGCTGGATCAACACCTACACCGGCGAGAGCACCTACGCCGACGACTTCAAGGGC

AGGTTCGCCTTCAGCCTGGACACCAGCGCCAGCACCGCCTACCTGCAGCTGAGCAGCCTGAGGGGCGAGGACACCGCC

GTGTACTTCTGCGCCAGGTTCGCCATCAAGGGCGACTACTGGGGCCAGGGCACCACCGTGACCGTGAGCAGCGCCAGC

-continued

ACCGGCGGCGGCGGCAGCGGCGGCGGCGGCAGCGGCGGCGGCGGCAGCGGCGGCGGCGGCAGCGACATCGTGATGACC

CAGAGCCCCCTGAGCCTGGAGGTGAGCCCCGGCGAGCCCGCCAGCATCAGCTGCAGGAGCACCAAGAGCCTGCTGCAC

AGCGACGGCATCACCTACCTGTACTGGTACCTGCAGAAGCCCGGCCAGAGCCCCCAGCTGCTGATCTACCAGCTGAGC

AACCTGGCCAGCGGCGTGCCCGACAGGTTCAGCAGCAGCGGCAGCGGCACCGACTTCACCCTGAAGATCAGCAGGGTG

GAGGCCGAGGACGAGGGCACCTACTACTGCGCCCAGAACCTGGAGATCCCCAGGACCTTCGGCCAGGGCACCAAGCTG

GAGATCAAGAGGACCCATCATCACCATCACCAT

SEQ ID NO. 287

ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

GCCATCTGGCTTTTCATCTTCAACGTCTCTCAACAGATGGGGGGCTTCTACCTGTGCCAGCCGGGGCCCCCCTCTGAG

AAGGCCTGGCAGCCTGGCTGGACAGTCAATGTGGAGGGCAGCGGGGAGCTGTTCCGGTGGAATGTTTCGGACCTAGGT

GGCCTGGGCTGTGGCCTGAAGAACAGGTCCTCAGAGGGCCCCAGCTCCCCTTCCGGGAAGCTCATGAGCCCCAAGCTG

TATGTGTGGGCCAAAGACCGCCCTGAGATCTGGGAGGGAGAGCCTCCGTGTCTCCCACCGAGGGACAGCCTGAACCAG

AGCCTCAGCCAGGACCTCACCATGGCCCCTGGCTCCACACTCTGGCTGTCCTGTGGGGTACCCCCTGACTCTGTGTCC

AGGGGCCCCCTCTCCTGGACCCATGTGCACCCCAAGGGGCCTAAGTCATTGCTGAGCCTAGAGCTGAAGGACGATCGC

CCGGCCAGAGATATGTGGGTAATGGAGACGGGTCTGTTGTTGCCCCGGGCCACAGCTCAAGACGCTGGAAAGTATTAT

TGTCACCGTGGCAACCTGACCATGTCATTCCACCTGGAGATCACTGCTCGGCCAGGAGGAGGTGGGTCTGGAGGTGGA

GGATCTGGTGGAGGTGGGTCTGGAGGAGGTGGGTCTCAGGTTCAGCTGGTGCAGTCTGGTGCTGAGGATGTGAAGCCT

GATGCCTCAGTGAAGCTCTCCTGCAAGGCTTCTGGTTACACATTCACTGACTACTACATGCACTGGGTGCGTCAGGCC

CCTGGTCAAGGTCTTGAGTGGATGGGTCGTGTTAATCCTAACCGGAGGGGTACTACCTACAACCAGAAATTCGAGGGC

CGTGTCACCATGACCACAGACACATCCACGAGCACAGCCTACATGCAGCTGAGTAGCCTGCGTGGTGAAGACACGGCC

GTGTATTACTGTGCGCGTGCGAACTGGCTTGACTACTGGGGCCAGGGCACCACCGTCACCGTCTCCTCCGCCTCCACC

GGGGGAGGTGGGTCTGGAGGTGGAGGATCTGGTGGAGGTGGGTCTGGTGGAGGTGGGTCTGACATCCAGATGACCCAG

TCTCCATCCTCCCTGGAGGCATCTGTAGGAGACAGAGTCACCATCACTTGCAGTGTCAGCTCAAGTGTATCCTCCATT

TACTTGCACTGGTATCAGCAGAAACCAGGGAAAAGCCCTAAGCTCCTGATCTATAGCACATCCAACTTGGCTTCTGGA

GTCCCAGATAGGTTCAGTGGCAGTGGATCTGGGACAGATTTCACTCTCACCATCAGCAGTCTGCAAGCCGAAGATGAG

GGCACTTACTACTGTCAAGTCTACAGTGGTTACCCGCTCACGTTCGGCGGAGGGACCAAGCTGGAGATCAAACGAACT

CATCATCACCATCACCAT

SEQ ID NO. 288

ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

GCCATCTGGCTTTTCATCTTCAACGTCTCTCAACAGATGGGGGGCTTCTACCTGTGCCAGCCGGGGCCCCCCTCTGAG

AAGGCCTGGCAGCCTGGCTGGACAGTCAATGTGGAGGGCAGCGGGGAGCTGTTCCGGTGGAATGTTTCGGACCTAGGT

GGCCTGGGCTGTGGCCTGAAGAACAGGTCCTCAGAGGGCCCCAGCTCCCCTTCCGGGAAGCTCATGAGCCCCAAGCTG

TATGTGTGGGCCAAAGACCGCCCTGAGATCTGGGAGGGAGAGCCTCCGTGTCTCCCACCGAGGGACAGCCTGAACCAG

AGCCTCAGCCAGGACCTCACCATGGCCCCTGGCTCCACACTCTGGCTGTCCTGTGGGGTACCCCCTGACTCTGTGTCC

AGGGGCCCCCTCTCCTGGACCCATGTGCACCCCAAGGGGCCTAAGTCATTGCTGAGCCTAGAGCTGAAGGACGATCGC

CCGGCCAGAGATATGTGGGTAATGGAGACGGGTCTGTTGTTGCCCCGGGCCACAGCTCAAGACGCTGGAAAGTATTAT

TGTCACCGTGGCAACCTGACCATGTCATTCCACCTGGAGATCACTGCTCGGCCAGGAGGAGGTGGGTCTGGAGGTGGA

-continued

GGATCTGGTGGAGGTGGGTCTGGAGGAGGTGGGTCTCAGGTGCAGCTGCAGGAGAGCGGCCCCGGCGACGTGAAGCCC

AGCGAGACCCTGAGCCTGACCTGCACCGTGAGCGGCGGCAGCGTGAGCAGCGGCGACTACTACTGGACCTGGATCAGG

CAGAGCCCCGGCAAGGGCCTGGAGTGGATCGGCCACATCTACTACAGCGGCAACACCAACTACAACCCCAGCCTGAAG

AGCAGGCTGACCATCAGCATCGACACCAGCAAGACCACCTTCAGCCTGCAGCTGAGCAGCGTGACCGGCGAGGACACC

GCCATCTACTACTGCGTGAGGGACAGGGTGACCGGCGCCTTCGACATCTGGGGCCAGGGCACCACCGTGACCGTGAGC

AGCGCCAGCACCGGCGGCGGCGGCAGCGGCGGCGGCGGCAGCGGCGGCGGCGGCAGCGGCGGCGGCGGCAGCGACATC

CAGATGACCCAGAGCCCCAGCAGCCTGGAGGCCAGCGTGGGCGACAGGGTGACCATCACCTGCCAGGCCAGCCAGGAC

ATCAGCAACTACCTGAACTGGTACCAGCAGAAGCCCGGCAAGAGCCCCAAGCTGCTGATCTACGACGCCAGCAACCTG

GAGACCGGCGTGCCCGACAGGTTCAGCGGCAGCGGCAGCGGCACCGACTTCACCTTCACCATCAGCAGCCTGCAGGCC

GAGGACGAGGGCACCTACTTCTGCCAGCACTTCGACCACCTGCCCCTGGCCTTCGGCGGCGGCACCAAGCTGGAGATC

AAGAGGACCCATCATCACCATCACCAT

SEQ ID NO. 289

ATGGAGACAGACACACTCCTGCTATGGGTACTGCTGCTCTGGGTTCCAGGTTCCACTGGTGACATCGTGCTGACCCAG

AGCCCCCCCAGCCTGGCCATGAGCCTGGGCAAGAGGGCCACCATCAGCTGCAGGGCCAGCGAGAGCGTGACCATCCTG

GGCAGCCACCTGATCCACTGGTACCAGCAGAAGCCCGGCCAGCCCCCCACCCTGCTGATCCAGCTGGCCAGCAACGTG

CAGACCGGCGTGCCCGCCAGGTTCAGCGGCAGCGGCAGCAGGACCGACTTCACCCTGACCATCGACCCCGTGGAGGAG

GACGACGTGGCCGTGTACTACTGCCTGCAGAGCAGGACCATCCCCAGGACCTTCGGCGGCGGCACCAAGCTGGAGATC

AAGGGCAGCACCAGCGGCAGCGGCAAGCCCGGCAGCGGCGAGGGCAGCACCAAGGGCCAGATCCAGCTGGTGCAGAGC

GGCCCCGAGCTGAAGAAGCCCGGCGAGACCGTGAAGATCAGCTGCAAGGCCAGCGGCTACACCTTCACCGACTACAGC

ATCAACTGGGTGAAGAGGGCCCCCGGCAAGGGCCTGAAGTGGATGGGCTGGATCAACACCGAGACCAGGGAGCCCGCC

TACGCCTACGACTTCAGGGGCAGGTTCGCCTTCAGCCTGGAGACCAGCGCCAGCACCGCCTACCTGCAGATCAACAAC

CTGAAGTACGAGGACACCGCCACCTACTTCTGCGCCCTGGACTACAGCTACGCCATGGACTACTGGGGCCAGGGCACC

AGCGTGACCGTGAGCAGCGGAGGAGGTGGGTCTGGAGGTGGAGGATCTGGTGGAGGTGGGTCTCATCATCACCATCAC

CAT

SEQ ID NO. 290

ATGGAGTTTGGGCTGAGCTGGGTTTTCCTCGTTGCTCTTTTTAGAGGTGTCCAGTGTCAGATCCAGCTGGTGCAGAGC

GGCCCCGAGCTGAAGAAGCCCGGCGAGACCGTGAAGATCAGCTGCAAGGCCAGCGGCTACACCTTCACCGACTACAGC

ATCAACTGGGTGAAGAGGGCCCCCGGCAAGGGCCTGAAGTGGATGGGCTGGATCAACACCGAGACCAGGGAGCCCGCC

TACGCCTACGACTTCAGGGGCAGGTTCGCCTTCAGCCTGGAGACCAGCGCCAGCACCGCCTACCTGCAGATCAACAAC

CTGAAGTACGAGGACACCGCCACCTACTTCTGCGCCCTGGACTACAGCTACGCCATGGACTACTGGGGCCAGGGCACC

AGCGTGACCGTGAGCAGCGGCAGCACCAGCGGCAGCGGCAAGCCCGGCAGCGGCGAGGGCAGCACCAAGGGC

GACATCGTGCTGACCCAGAGCCCCCCCAGCCTGGCCATGAGCCTGGGCAAGAGGGCCACCATCAGCTGCAGGGCCAGC

GAGAGCGTGACCATCCTGGGCAGCCACCTGATCCACTGGTACCAGCAGAAGCCCGGCCAGCCCCCCACCCTGCTGATC

CAGCTGGCCAGCAACGTGCAGACCGGCGTGCCCGCCAGGTTCAGCGGCAGCGGCAGCAGGACCGACTTCACCCTGACC

ATCGACCCCGTGGAGGAGGACGACGTGGCCGTGTACTACTGCCTGCAGAGCAGGACCATCCCCAGGACCTTCGGCGGC

GGCACCAAGCTGGAGATCAAGGGAGGAGGTGGGTCTGGAGGTGGAGGATCTGGTGGAGGTGGGTCTCATCATCACCAT

CACCAT

SEQ ID NO. 291

ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

GCCATCTGGCTTTTCATCTTCAACGTCTCTCAACAGATGGGGGGCTTCTACCTGTGCCAGCCGGGGCCCCCCTCTGAG

```
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGACAGCCTGAACCAG
AGCCTCAGCCAGGACCTCACCATGGCCCCTGGCTCCACACTCTGGCTGTCCTGTGGGGTACCCCCTGACTCTGTGTCC
AGGGGCCCCCTCTCCTGGACCCATGTGCACCCCAAGGGGCCTAAGTCATTGCTGAGCCTAGAGCTGAAGGACGATCGC
CCCGGCCAGAGATATGTGGGTAATGGAGACGGGTCTGTTGTTGCCCCGGGCCACAGCTCAAGACGCTGGAAAGTATTAT
TGTCACCGTGGCAACCTGACCATGTCATTCCACCTGGAGATCACTGCTCGGCCAGGAGGAGGTGGGTCTGGAGGTGGA
GGATCTGGTGGAGGTGGGTCTGGAGGAGGTGGGTCTGACATCGTGCTGACCCAGAGCCCCCCCAGCCTGGCCATGAGC
CTGGGCAAGAGGGCCACCATCAGCTGCAGGGCCAGCGAGAGCGTGACCATCCTGGGCAGCCACCTGATCCACTGGTAC
CAGCAGAAGCCCGGCCAGCCCCCCACCCTGCTGATCCAGCTGGCCAGCAACGTGCAGACCGGCGTGCCCGCCAGGTTC
AGCGGCAGCGGCAGCAGGACCGACTTCACCCTGACCATCGACCCCGTGGAGGAGGACGACGTGGCCGTGTACTACTGC
CTGCAGAGCAGGACCATCCCCAGGACCTTCGGCGGCGGCACCAAGCTGGAGATCAAGGGCAGCACCAGCGGCAGCGGC
AAGCCCGGCAGCGGCGAGGGCAGCACCAAGGGCCAGATCCAGCTGGTGCAGAGCGGCCCCGAGCTGAAGAAGCCCGGC
GAGACCGTGAAGATCAGCTGCAAGGCCAGCGGCTACACCTTCACCGACTACAGCATCAACTGGGTGAAGAGGGCCCCC
GGCAAGGGCCTGAAGTGGATGGGCTGGATCAACACCGAGACCAGGGAGCCCGCCTACGCCTACGACTTCAGGGGCAGG
TTCGCCTTCAGCCTGGAGACCAGCGCCAGCACCGCCTACCTGCAGATCAACAACCTGAAGTACGAGGACACCGCCACC
TACTTCTGCGCCCTGGACTACAGCTACGCCATGGACTACTGGGGCCAGGGCACCAGCGTGACCGTGAGCAGCGGAGGA
GGTGGGTCTGGAGGTGGAGGATCTGGTGGAGGTGGGTCTCATCATCACCATCACCAT
```
```
                                                           SEQ ID NO. 292
ATGCCACCTCCTCGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCAGCAGCTGACCTGG
TCTCGGGAGTCCCCGCTTAAACCCTTCTTAAAACTCAGCCTGGGGCTGCCAGGCCTGGGAATCCACATGAGGCCCCTG
GCCATCTGGCTTTTCATCTTCAACGTCTCTCAACAGATGGGGGGCTTCTACCTGTGCCAGCCGGGGCCCCCCTCTGAG
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGACAGCCTGAACCAG
AGCCTCAGCCAGGACCTCACCATGGCCCCTGGCTCCACACTCTGGCTGTCCTGTGGGGTACCCCCTGACTCTGTGTCC
AGGGGCCCCCTCTCCTGGACCCATGTGCACCCCAAGGGGCCTAAGTCATTGCTGAGCCTAGAGCTGAAGGACGATCGC
CCCGGCCAGAGATATGTGGGTAATGGAGACGGGTCTGTTGTTGCCCCGGGCCACAGCTCAAGACGCTGGAAAGTATTAT
TGTCACCGTGGCAACCTGACCATGTCATTCCACCTGGAGATCACTGCTCGGCCAGGAGGAGGTGGGTCTGGAGGTGGA
GGATCTGGTGGAGGTGGGTCTGGAGGAGGTGGGTCTCAGATCCAGCTGGTGCAGAGCGGCCCCGAGCTGAAGAAGCCC
GGCGAGACCGTGAAGATCAGCTGCAAGGCCAGCGGCTACACCTTCACCGACTACAGCATCAACTGGGTGAAGAGGGCC
CCCGGCAAGGGCCTGAAGTGGATGGGCTGGATCAACACCGAGACCAGGGAGCCCGCCTACGCCTACGACTTCAGGGGC
AGGTTCGCCTTCAGCCTGGAGACCAGCGCCAGCACCGCCTACCTGCAGATCAACAACCTGAAGTACGAGGACACCGCC
ACCTACTTCTGCGCCCTGGACTACAGCTACGCCATGGACTACTGGGGCCAGGGCACCAGCGTGACCGTGAGCAGCGGC
AGCACCAGCGGCAGCGGCAAGCCCGGCAGCGGCGAGGGCAGCACCAAGGGCGACATCGTGCTGACCCAGAGCCCCCCC
AGCCTGGCCATGAGCCTGGGCAAGAGGGCCACCATCAGCTGCAGGGCCAGCGAGAGCGTGACCATCCTGGGCAGCCAC
CTGATCCACTGGTACCAGCAGAAGCCCGGCCAGCCCCCCACCCTGCTGATCCAGCTGGCCAGCAACGTGCAGACCGGC
GTGCCCGCCAGGTTCAGCGGCAGCGGCAGCAGGACCGACTTCACCCTGACCATCGACCCCGTGGAGGAGGACGACGTG
GCCGTGTACTACTGCCTGCAGAGCAGGACCATCCCCAGGACCTTCGGCGGCGGCACCAAGCTGGAGATCAAGGGAGGA
GGTGGGTCTGGAGGTGGAGGATCTGGTGGAGGTGGGTCTCATCATCACCATCACCAT
```

-continued

SEQ ID NO. 293
ATGCCACCTCCTCGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCAGCAGCTGACCTGG
TCTCGGGAGTCCCCGCTTAAACCCTTCTTAAAACTCAGCCTGGGGCTGCCAGGCCTGGGAATCCACATGAGGCCCCTG
GCCATCTGGCTTTTCATCTTCAACGTCTCTCAACAGATGGGGGCTTCTACCTGTGCCAGCCGGGGCCCCCCTCTGAG
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGACAGCCTGAACCAG
AGCCTCAGCCAGGACCTCACCATGGCCCCTGGCTCCACACTCTGGCTGTCCTGTGGGGTACCCCCTGACTCTGTGTCC
AGGGGCCCCCTCTCCTGGACCCATGTGCACCCCAAGGGGCCTAAGTCATTGCTGAGCCTAGAGCTGAAGGACGATCGC
CCGGCCAGAGATATGTGGGTAATGGAGACGGGTCTGTTGTTGCCCCGGGCCACAGCTCAAGACGCTGGAAAGTATTAT
TGTCACCGTGGCAACCTGACCATGTCATTCCACCTGGAGATCACTGCTCGGCCAGACAAAACTCACACATGCCCACCG
TGCCCAGCACCTGAACTCCTGGGGGGACCGTCAGTCTTCCTCTTCCCCCCAAAACCCAAGGACACCCTCATGATCTCC
CGGACCCCTGAGGTCACATGCGTGGTGGTGGACGTGAGCCACGAAGACCCTGAGGTCAAGTTCAACTGGTACGTGGAC
GGCGTGGAGGTGCATAATGCCAAGACAAAGCCGCGGGAGGAGCAGTACAACAGCACGTACCGTGTGGTCAGCGTCCTC
ACCGTCCTGCACCAGGACTGGCTGAATGGCAAGGAGTACAAGTGCAAGGTCTCCAACAAAGCCCTCCCAGCCCCCATC
GAGAAAACCATCTCCAAAGCCAAAGGGCAGCCCCGAGAACCACAGGTGTACACCCTGCCCCCATCCCGGGAGGAGATG
ACCAAGAACCAGGTCAGCCTGACCTGCCTGGTCAAAGGCTTCTATCCCAGCGACATCGCCGTGGAGTGGGAGAGCAAT
GGGCAGCCGGAGAACAACTACAAGACCACGCCTCCCGTGCTGGACTCCGACGGCTCCTTCTTCCTCTACAGCAAGCTC
ACCGTGGACAAGAGCAGGTGGCAGCAGGGGAACGTCTTCTCATGCTCCGTGATGCACGAGGCTCTGCACAACCACTAC
ACGCAGAAGAGCCTCTCCCTGTCTCCGGGTGGAGGAGGTGGGTCTGGAGGTGGAGGATCTGGTGGAGGTGGGTCTGGA
GGAGGTGGGTCTGAGGTGCAGCTGGTGGAGTCTGGTGGTGGTCTTGTTCAACCTGGTGGTTCTCTTCGTCTTTCTTGT
GCTGCTTCTGGTTTTAATATTAAAGATACTTATATTCATTGGGTTCGTCAAGCTCCTGGTAAAGGTCTTGAATGGGTT
GCTCGTATTTATCCTACTAATGGTTATACTCGTTATGCTGATTCTGTTAAAGGTCGTTTTACTATTTCTGCTGATACT
TCTAAAAATACTGCTTATCTTCAAATGAACTCTCTTCGTGCTGAAGATACTGCTGTTTATTATTGTTCTCGTTGGGGT
GGTGATGGTTTTTATGCTATGGATTATTGGGGTCAAGGTACTCTTGTCACCGTCTCCTCAGCTAGCACCGGGGGAGGT
GGGTCTGGAGGTGGAGGATCTGGTGGAGGTGGGTCTGACATCCAGATGACCCAGTCTCCTTCTTCTCTTTCTGCTTCT
GTTGGTGATCGTGTTACTATTACTTGTCGTGCTTCTCAAGATGTTAATACTGCTGTTGCTTGGTATCAACAAAAACCT
GGTAAAGCTCCTAAACTTCTTATTTATTCTGCTTCTTTTCTTTATTCTGGTGTTCCTTCTCGTTTTTCTGGTTCTCGT
TCTGGTACTGATTTTACTCTTACTATTTCTTCTCTTCAACCTGAAGATTTTGCTACTTATTATTGTCAACAACATTAT
ACTACTCCTCCTACTTTTGGTCAAGGTACCAAGGTGGAGATCAAACGTACG

SEQ ID NO. 294
ATGCCACCTCCTCGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCAGCAGCTGACCTGG
TCTCGGGAGTCCCCGCTTAAACCCTTCTTAAAACTCAGCCTGGGGCTGCCAGGCCTGGGAATCCACATGAGGCCCCTG
GCCATCTGGCTTTTCATCTTCAACGTCTCTCAACAGATGGGGGCTTCTACCTGTGCCAGCCGGGGCCCCCCTCTGAG
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGACAGCCTGAACCAG
AGCCTCAGCCAGGACCTCACCATGGCCCCTGGCTCCACACTCTGGCTGTCCTGTGGGGTACCCCCTGACTCTGTGTCC
AGGGGCCCCCTCTCCTGGACCCATGTGCACCCCAAGGGGCCTAAGTCATTGCTGAGCCTAGAGCTGAAGGACGATCGC
CCGGCCAGAGATATGTGGGTAATGGAGACGGGTCTGTTGTTGCCCCGGGCCACAGCTCAAGACGCTGGAAAGTATTAT

-continued

```
TGTCACCGTGGCAACCTGACCATGTCATTCCACCTGGAGATCACTGCTCGGCCAGGGGAGGTGGGTCTGGAGGTGGA
GGATCTGGTGGAGGTGGGTCTGGTGGAGGTGGGTCTGAGGTGCAGCTGGTGGAGTCTGGTGGTGGTCTTGTTCAACCT
GGTGGTTCTCTTCGTCTTTCTTGTGCTGCTTCTGGTTTTAATATTAAAGATACTTATATTCATTGGGTTCGTCAAGCT
CCTGGTAAAGGTCTTGAATGGGTTGCTCGTATTTATCCTACTAATGGTTATACTCGTTATGCTGATTCTGTTAAAGGT
CGTTTTACTATTTCTGCTGATACTTCTAAAAATACTGCTTATCTTCAAATGAACTCTCTTCGTGCTGAAGATACTGCT
GTTTATTATTGTTCTCGTTGGGGTGGTGATGGTTTTTATGCTATGGATTATTGGGGTCAAGGTACTCTTGTCACCGTC
TCCTCAGCTAGCACCGGGGAGGTGGGTCTGGAGGTGGAGGATCTGGTGGAGGTGGGTCTGACATCCAGATGACCCAG
TCTCCTTCTTCTCTTTCTGCTTCTGTTGGTGATCGTGTTACTATTACTTGTCGTGCTTCTCAAGATGTTAATACTGCT
GTTGCTTGGTATCAACAAAAACCTGGTAAAGCTCCTAAACTTCTTATTTATTCTGCTTCTTTTCTTTATTCTGGTGTT
CCTTCTCGTTTTTCTGGTTCTCGTTCTGGTACTGATTTTACTCTTACTATTTCTTCTCTTCAACCTGAAGATTTTGCT
ACTTATTATTGTCAACAACATTATACTACTCCTCCTACTTTTGGTCAAGGTACCAAGGTGGAGATCAAACGTACGGGA
GGAGGTGGGTCTGGAGGTGGAGGATCTGGTGGAGGTGGGTCTGGAGGAGGTGGGTCTCAGGTGCAGCTGCAGGAGAGC
GGCCCCGGCGACGTGAAGCCCAGCGAGACCCTGAGCCTGACCTGCACCGTGAGCGGCGGCAGCGTGAGCAGCGGCGAC
TACTACTGGACCTGGATCAGGCAGAGCCCCGGCAAGGGCCTGGAGTGGATCGGCCACATCTACTACAGCGGCAACACC
AACTACAACCCCAGCCTGAAGAGCAGGCTGACCATCAGCATCGACACCAGCAAGACCACCTTCAGCCTGCAGCTGAGC
AGCGTGACCGGCGAGGACACCGCCATCTACTACTGCGTGAGGGACAGGGTGACCGGCGCCTTCGACATCTGGGGCCAG
GGCACCACCGTGACCGTGAGCAGCGCCAGCACCGGCGGAGGTGGCAGCGGCGGAGGTGGCAGCGGCGGAGGTGGCAGC
GGCGGAGGTGGCAGCGACATCCAGATGACCCAGAGCCCCAGCAGCCTGGAGGCCAGCGTGGGCGACAGGGTGACCATC
ACCTGCCAGGCCAGCCAGGACATCAGCAACTACCTGAACTGGTACCAGCAGAAGCCCGGCAAGAGCCCCAAGCTGCTG
ATCTACGACGCCAGCAACCTGGAGACCGGCGTGCCCGACAGGTTCAGCGGCAGCGGCAGCGGCACCGACTTCACCTTC
ACCATCAGCAGCCTGCAGGCCGAGGACGAGGGCACCTACTTCTGCCAGCACTTCGACCACCTGCCCCTGGCCTTCGGC
GGCGGCACCAAGCTGGAGATCAAGAGGACCGGAGGAGGTGGGTCTCATCATCACCATCACCAT
```

SEQ ID NO. 295
```
ATGCCACCTCCTCGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCAGCAGCTGACCTGG
TCTCGGGAGTCCCCGCTTAAACCCTTCTTAAAACTCAGCCTGGGGCTGCCAGGCCTGGGAATCCACATGAGGCCCCTG
GCCATCTGGCTTTTCATCTTCAACGTCTCTCAACAGATGGGGGGCTTCTACCTGTGCCAGCCGGGGCCCCCCTCTGAG
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGACAGCCTGAACCAG
AGCCTCAGCCAGGACCTCACCATGGCCCCTGGCTCCACACTCTGGCTGTCCTGTGGGGTACCCCCTGACTCTGTGTCC
AGGGGCCCCCTCTCCTGGACCCATGTGCACCCCAAGGGGCCTAAGTCATTGCTGAGCCTAGAGCTGAAGGACGATCGC
CCGGCCAGAGATATGTGGGTAATGGAGACGGGTCTGTTGTTGCCCCGGGCCACAGCTCAAGACGCTGGAAAGTATTAT
TGTCACCGTGGCAACCTGACCATGTCATTCCACCTGGAGATCACTGCTCGGCCAGGGGAGGTGGGTCTGGAGGTGGA
GGATCTGGTGGAGGTGGGTCTGGTGGAGGTGGGTCTGAGGTGCAGCTGGTGGAGTCTGGTGGTGGTCTTGTTCAACCT
GGTGGTTCTCTTCGTCTTTCTTGTGCTGCTTCTGGTTTTAATATTAAAGATACTTATATTCATTGGGTTCGTCAAGCT
CCTGGTAAAGGTCTTGAATGGGTTGCTCGTATTTATCCTACTAATGGTTATACTCGTTATGCTGATTCTGTTAAAGGT
CGTTTTACTATTTCTGCTGATACTTCTAAAAATACTGCTTATCTTCAAATGAACTCTCTTCGTGCTGAAGATACTGCT
GTTTATTATTGTTCTCGTTGGGGTGGTGATGGTTTTTATGCTATGGATTATTGGGGTCAAGGTACTCTTGTCACCGTC
TCCTCAGCTAGCACCGGGGAGGTGGGTCTGGAGGTGGAGGATCTGGTGGAGGTGGGTCTGACATCCAGATGACCCAG
TCTCCTTCTTCTCTTTCTGCTTCTGTTGGTGATCGTGTTACTATTACTTGTCGTGCTTCTCAAGATGTTAATACTGCT
```

```
GTTGCTTGGTATCAACAAAAACCTGGTAAAGCTCCTAAACTTCTTATTTATTCTGCTTCTTTTCTTTATTCTGGTGTT

CCTTCTCGTTTTTCTGGTTCTCGTTCTGGTACTGATTTTACTCTTACTATTTCTTCTCTTCAACCTGAAGATTTTGCT

ACTTATTATTGTCAACAACATTATACTACTCCTCCTACTTTTGGTCAAGGTACCAAGGTGGAGATCAAACGTACGGGA

GGAGGTGGGTCTGGAGGTGGAGGATCTGGTGGAGGTGGGTCTGGAGGAGGTGGGTCTGACATCCAGATGACCCAGAGC

CCCAGCAGCCTGGAGGCCAGCGTGGGCGACAGGGTGACCATCACCTGCCAGGCCAGCCAGGACATCAGCAACTACCTG

AACTGGTACCAGCAGAAGCCCGGCAAGAGCCCCAAGCTGCTGATCTACGACGCCAGCAACCTGGAGACCGGCGTGCCC

GACAGGTTCAGCGGCAGCGGCAGCGGCACCGACTTCACCTTCACCATCAGCAGCCTGCAGGCCGAGGACGAGGGCACC

TACTTCTGCCAGCACTTCGACCACCTGCCCCTGGCCTTCGGCGGCGGCACCAAGCTGGAGATCAAGAGGACCGGCGGA

GGTGGCAGCGGCGGAGGTGGCAGCGGCGGAGGTGGCAGCGGCGGAGGTGGCAGCCAGGTGCAGCTGCAGGAGAGCGGC

CCCGGCGACGTGAAGCCCAGCGAGACCCTGAGCCTGACCTGCACCGTGAGCGGCGGCAGCGTGAGCAGCGGCGACTAC

TACTGGACCTGGATCAGGCAGAGCCCCGGCAAGGGCCTGGAGTGGATCGGCCACATCTACTACAGCGGCAACACCAAC

TACAACCCCAGCCTGAAGAGCAGGCTGACCATCAGCATCGACACCAGCAAGACCCACCTTCAGCCTGCAGCTGAGCAGC

GTGACCGGCGAGGACACCGCCATCTACTACTGCGTGAGGGACAGGGTGACCGGCGCCTTCGACATCTGGGGCCAGGGC

ACCACCGTGACCGTGAGCAGCGCCAGCACCGGAGGAGGTGGGTCTCATCATCACCATCACCAT
```

SEQ ID NO. 296

```
ATGGAGTTTGGGCTGAGCTGGGTTTTCCTCGTTGCTCTTTTTAGAGGTGTCCAGTGTGAGGTGCAGCTGGTGGAGTCT

GGTGGTGGTCTTGTTCAACCTGGTGGTTCTCTTCGTCTTTCTTGTGCTGCTTCTGGTTTTAATATTAAAGATACTTAT

ATTCATTGGGTTCGTCAAGCTCCTGGTAAAGGTCTTGAATGGGTTGCTCGTATTTATCCTACTAATGGTTATACTCGT

TATGCTGATTCTGTTAAAGGTCGTTTTACTATTTCTGCTGATACTTCTAAAAATACTGCTTATCTTCAAATGAACTCT

CTTCGTGCTGAAGATACTGCTGTTTATTATTGTTCTCGTGGGGTGGTGATGGTTTTTATGCTATGGATTATTGGGGT

CAAGGTACTCTTGTCACCGTCTCCTCAGCTAGCACCGGGGGAGGTGGGTCTGGAGGTGGAGGATCTGGTGGAGGTGGG

TCTGACATCCAGATGACCCAGTCTCCTTCTTCTCTTTCTGCTTCTGTTGGTGATCGTGTTACTATTACTTGTCGTGCT

TCTCAAGATGTTAATACTGCTGTTGCTTGGTATCAACAAAAACCTGGTAAAGCTCCTAAACTTCTTATTTATTCTGCT

TCTTTTCTTTATTCTGGTGTTCCTTCTCGTTTTTCTGGTTCTCGTTCTGGTACTGATTTTACTCTTACTATTTCTTCT

CTTCAACCTGAAGATTTTGCTACTTATTATTGTCAACAACATTATACTACTCCTCCTACTTTTGGTCAAGGTACCAAG

GTGGAGATCAAACGTACGGGAGGAGGTGGGTCTGGAGGTGGAGGATCTGGTGGAGGTGGGTCTGGAGGAGGTGGGTCT

CAGGTGCAGCTGCAGGAGAGCGGCCCCGGCGACGTGAAGCCCAGCGAGACCCTGAGCCTGACCTGCACCGTGAGCGGC

GGCAGCGTGAGCAGCGGCGACTACTACTGGACCTGGATCAGGCAGAGCCCCGGCAAGGGCCTGGAGTGGATCGGCCAC

ATCTACTACAGCGGCAACACCAACTACAACCCCAGCCTGAAGAGCAGGCTGACCATCAGCATCGACACCAGCAAGACC

ACCTTCAGCCTGCAGCTGAGCAGCGTGACCGGCGAGGACACCGCCATCTACTACTGCGTGAGGGACAGGGTGACCGGC

GCCTTCGACATCTGGGGCCAGGGCACCACCGTGACCGTGAGCAGCGCCAGCACCGGCGGAGGTGGCAGCGGCGGAGGT

GGCAGCGGCGGAGGTGGCAGCGGCGGAGGTGGCAGCGACATCCAGATGACCCAGAGCCCCAGCAGCCTGGAGGCCAGC

GTGGGCGACAGGGTGACCATCACCTGCCAGGCCAGCCAGGACATCAGCAACTACCTGAACTGGTACCAGCAGAAGCCC

GGCAAGAGCCCCAAGCTGCTGATCTACGACGCCAGCAACCTGGAGACCGGCGTGCCCGACAGGTTCAGCGGCAGCGGC

AGCGGCACCGACTTCACCTTCACCATCAGCAGCCTGCAGGCCGAGGACGAGGGCACCTACTTCTGCCAGCACTTCGAC

CACCTGCCCCTGGCCTTCGGCGGCGGCACCAAGCTGGAGATCAAGAGGACCGGAGGAGGTGGGTCTCATCATCACCAT

CACCAT
```

SEQ ID NO. 297

```
ATGGAGTTTGGGCTGAGCTGGGTTTTCCTCGTTGCTCTTTTTAGAGGTGTCCAGTGTGAGGTGCAGCTGGTGGAGTCT

GGTGGTGGTCTTGTTCAACCTGGTGGTTCTCTTCGTCTTTCTTGTGCTGCTTCTGGTTTTAATATTAAAGATACTTAT

ATTCATTGGGTTCGTCAAGCTCCTGGTAAAGGTCTTGAATGGGTTGCTCGTATTTATCCTACTAATGGTTATACTCGT
```

-continued

TATGCTGATTCTGTTAAAGGTCGTTTTACTATTTCTGCTGATACTTCTAAAAATACTGCTTATCTTCAAATGAACTCT
CTTCGTGCTGAAGATACTGCTGTTTATTATTGTTCTCGTTGGGGTGGTGATGGTTTTTATGCTATGGATTATTGGGGT
CAAGGTACTCTTGTCACCGTCTCCTCAGCTAGCACCGGGGGAGGTGGGTCTGGAGGTGGAGGATCGGTGGAGGTGGG
TCTGACATCCAGATGACCCAGTCTCCTTCTTCTCTTTCTGCTTCTGTTGGTGATCGTGTTACTATTACTTGTCGTGCT
TCTCAAGATGTTAATACTGCTGTTGCTTGGTATCAACAAAAACCTGGTAAAGCTCCTAAACTTCTTATTTATTCTGCT
TCTTTTCTTTATTCTGGTGTTCCTTCTCGTTTTTCTGGTTCTCGTTCTGGTACTGATTTTACTCTTACTATTTCTTCT
CTTCAACCTGAAGATTTTGCTACTTATTATTGTCAACAACATTATACTACTCCTCCTACTTTTGGTCAAGGTACCAAG
GTGGAGATCAAACGTACGGAGGAGGTGGGTCTGGAGGTGGAGGATCGGTGGAGGTGGGTCTGGAGGAGGTGGGTCT
GACATCCAGATGACCCAGAGCCCCAGCAGCCTGGAGGCCAGCGTGGGCGACAGGGTGACCATCACCTGCCAGGCCAGC
CAGGACATCAGCAACTACCTGAACTGGTACCAGCAGAAGCCCGGCAAGAGCCCCAAGCTGCTGATCTACGACGCCAGC
AACCTGGAGACCGGCGTGCCCGACAGGTTCAGCGGCAGCGGCAGCGGCACCGACTTCACCTTCACCATCAGCAGCCTG
CAGGCCGAGGACGAGGGCACCTACTTCTGCCAGCACTTCGACCACCTGCCCCTGGCCTTCGGCGGCGGCACCAAGCTG
GAGATCAAGAGGACCGGCGGAGGTGGCAGCGGCGGAGGTGGCAGCGGCGGAGGTGGCAGCGGCGGAGGTGGCAGCCAG
GTGCAGCTGCAGGAGAGCGGCCCCGGCACGTGAAGCCCAGCGAGACCCTGAGCCTGACCTGCACCGTGAGCGGCGGC
AGCGTGAGCAGCGGCGACTACTACTGGACCTGGATCAGGCAGAGCCCCGGCAAGGGCCTGGAGTGGATCGGCCACATC
TACTACAGCGGCAACACCAACTACAACCCCAGCCTGAAGAGCAGGCTGACCATCAGCATCGACACCAGCAAGACCACC
TTCAGCCTGCAGCTGAGCAGCGTGACCGGCGAGGACACCGCCATCTACTACTGCGTGAGGGACAGGGTGACCGGCGCC
TTCGACATCTGGGGCCAGGGCACCACCGTGACCGTGAGCAGCGCCAGCACCGGAGGAGGTGGGTCTCATCATCACCAT
CACCAT

SEQ ID NO. 298
GATATCGAATTAGGAGGAAAACTGTTTCATACAGAAGGCGTCAATTAGGAGGAAAAACTGTTTCATACAGAAGGCGTC
AATTAGGAGGAAAAACTGTTTCATACAGAAGGCGTCAATTGGTCCCATCGAATTAGGAGGAAAAACTGTTTCATACAG
AAGGCGTCAATTAGGAGGAAAAACTGTTTCATACAGAAGGCGTCAATTAGGAGGAAAAACTGTTTCATACAGAAGGCG
TCAATTGGTCCCGGGACATTTTGACACCCCCATAATATTTTTCCAGAATTAACAGTATAAATTGCATCTCTTGTTCAA
GAGTTCCCTATCACTCTCTTTAATCACTACTCACAGTAACCTCAACTCCTGGCGGCCGCGCCACCATGCCACCTCCTC
GCCTCCTCTTCTTCCTCCTCTTCCTCACCCCCATGGAAGTCAGGCCCGAGGAACCTCTAGTGGTGAAGGTGGAAGAGG
GAGATAACGCTGTGCTGCAGTGCCTCAAGGGGACCTCAGATGGCCCCACTCAGCAGCTGACTTGGTCTCGGGAGTCCC
CGCTTAAACCCTTCTTAAAACTCAGCCTGGGGCTGCCAGGCCTGGGAATCCACATGAGGCCCCTGGCCATCTGGCTTT
TCATCTTCAACGTCTCTCAACAGATGGGGGGCTTCTACCTGTGCCAGCCGGGGCCCCCCTCTGAGAAGGCCTGGCAGC
CTGGCTGGACAGTCAATGTGGAGGGCAGCGGGGAGCTGTTCCGGTGGAATGTTTCGGACCTAGGTGGCCTGGGCTGTG
GCCTGAAGAACAGGTCCTCAGAGGGCCCCAGCTCCCCTTCCGGGAAGCTCATGAGCCCCAAGCTGTATGTGTGGGCCA
AAGACCGCCCTGAGATCTGGGAGGGAGAGCCTCCGTGTCTCCCACCGAGGGACAGCCTGAACCAGAGCCTCAGCCAGG
ACCTCACCATGGCCCCTGGCTCCACACTCTGGCTGTCCTGTGGGGTACCCCCTGACTCTGTGTCCAGGGGCCCCCTCT
CCTGGACCCATGTGCACCCCAAGGGGCCTAAGTCATTGCTGAGCCTAGAGCTGAAGGACGATCGCCCGGCCAGAGATA
TGTGGGTAATGGAGACGGGTCTGTTGTTGCCCCGGGCCACAGCTCAAGACGCTGGAAAGTATTATTGTCACCGTGGCA
ACCTGACCATGTCATTCCACCTGGAGATCACTGCTCGGCCAGGGGAGGTGGGTCTGGAGGTGGAGGATCTGGTGGAG
GTGGGTCTGGTGGAGGTGGGTCTGAGGTGCAGCTGGTGGAGTCTGGTGGTGGTCTTGTTCAACCCGGTGGTTCTCTTC
GTCTTTCTTGTGCTGCTTCTGGTTTTAATATTAAAGATACTTATATTCATTGGGTTCGTCAAGCTCCTGGTAAAGGTC
TTGAATGGGTTGCTCGTATTTATCCTACTAATGGTTATACTCGTTATGCTGATTCTGTTAAAGGTCGTTTTACTATTT
CTGCTGATACTTCTAAAAATACTGCTTATCTTCAAATGAACTCTCTTCGTGCTGAAGATACTGCTGTTTATTATTGTT
CTCGTTGGGGTGGTGATGGTTTTTATGCTATGGATTATTGGGGTCAAGGTACTCTTGTCACCGTCTCCTCAGCTAGCA

-continued

CCGGGGGAGGTGGGTCTGGAGGTGGAGGATCTGGTGGAGGTGGGTCTGACATCCAGATGACCCAGTCTCCTTCTTCTC
TTTCTGCTTCTGTTGGTGATCGTGTTACTATTACTTGTCGTGCTTCTCAAGATGTTAATACTGCTGTTGCTTGGTATC
AACAAAAACCCGGTAAAGCTCCTAAACTTCTTATTTATTCTGCTTCTTTTCTTTATTCTGGTGTTCCTTCTCGTTTTT
CTGGTTCTCGTTCTGGTACTGATTTTACTCTTACTATTTCTTCTCTTCAACCTGAAGATTTTGCTACTTATTATTGTC
AACAACATTATACTACTCCTCCTACTTTTGGTCAAGGTACCAAGGTGGAGATCAAACGTACGCATCATCACCATCACC
AT

SEQ ID NO. 299

ATGGATTTTCAGGTGCAGATTTTCAGCTTCCTGCTAATCAGTGCCTCAGTCATAATGTCTAGAATGGCCCAGGTCAAA
CTACAGGAGTCAGGGGCTGAGCTGGTGAAGCCTGGGGCCTCAGTGAAGATGTCCTGCAAGGCTTCTGGCTACACATTT
ACCAGTTACAATATGCACTGGGTAAAGCAGACACCTGGACAGGGCCTGGAATGGATTGGAGCTATTTATCCAGGAAAT
GGTGATACTTCCTACAATCAGAAGTTCAAAGGCAAGGCCACATTGACTGCAGACAAATCCTCCAGCACAGCCTACATG
CAGCTCAGCAGCCTGACATCTGAGGACTCTGCGGACTATTACTGTGCAAGATCTAATTATTACGGTAGTAGCTACTGG
TTCTTCGATGTCTGGGGCCAAGGGACCACGGTCACCGTCTCCTCAGGTGGAGGCGGTTCAGGCGGAGGTGGCTCTGGC
GGTGGCGGATCGGACATCGAGCTCACTCAGTCTCCAACAATCCTGTCTGCATCTCCAGGGGAGAAGGTCACAATGACT
TGCAGGGCCAGCTCAAGTGTAAATTACATGGACTGGTACCAGAAGAAGCCAGGATCCTCCCCCAAACCCTGGATTTAT
GCCACATCCAACCTGGCTTCTGGAGTCCCTGCTCGCTTCAGTGGCAGTGGGTCTGGGACCTCTTACTCTCTCACAATC
AGCAGAGTGGAGGCTGAAGATGCTGCCACTTATTACTGCCAGCAGTGGAGTTTTAATCCACCCACGTTCGGAGGGGGG
ACAAAGTTGGAAATAAAACGGGCCGCCGCTGGTGATCCCGCCGAGCCCAAATCTCCTGACAAAACTCACACATGCCCA
CCGTGCCCAGCACCTGAACTCCTGGGGGGACCGTCAGTCTTCCTCTTCCCCCCAAAACCCAAGGACACCCTCATGATC
TCCCGGACCCCTGAGGTCACATGCGTGGTGGTGGACGTGAGCCACGAAGACCCTGAGGTCAAGTTCAACTGGTACGTG
GACGGCGTGGAGGTGCATAATGCCAAGACAAAGCCGCGGGAGGAGCAGTACAACAGCACGTACCGTGTGGTCAGCGTC
CTCACCGTCCTGCACCAGGACTGGCTGAATGGCAAGGAGTACAAGTGCAAGGTCTCCAACAAAGCCCTCCCAGCCCCC
ATCGAGAAACCATCTCCAAAGCCAAAGGGCAGCCCCGAGAACCACAGGTGTACACCCTGCCCCCATCCCGGGAGGAG
ATGACCAAGAACCAGGTCAGCCTGACCTGCCTGGTCAAAGGCTTCTATCCCAGCGACATCGCCGTGGAGTGGGAGAGC
AATGGGCAGCCGGAGAACAACTACAAGACCACGCCTCCCGTGCTGGACTCCGACGGCTCCTTCTTCCTCTACAGCAAG
CTCACCGTGGACAAGAGCAGGTGGCAGCAGGGGAACGTCTTCTCATGCTCCGTGATGCACGAGGCTCTGCACAACCAC
TACACGCAGAAGAGCCTCTCCCTGTCTCCGGGT

SEQ ID NO. 300

ATGGATTTTCAGGTGCAGATTTTCAGCTTCCTGCTAATCAGTGCCTCAGTCATAATGTCTAGAATGGCCCAGGTCAAA
CTACAGGAGTCAGGGGCTGAGCTGGTGAAGCCTGGGGCCTCAGTGAAGATGTCCTGCAAGGCTTCTGGCTACACATTT
ACCAGTTACAATATGCACTGGGTAAAGCAGACACCTGGACAGGGCCTGGAATGGATTGGAGCTATTTATCCAGGAAAT
GGTGATACTTCCTACAATCAGAAGTTCAAAGGCAAGGCCACATTGACTGCAGACAAATCCTCCAGCACAGCCTACATG
CAGCTCAGCAGCCTGACATCTGAGGACTCTGCGGACTATTACTGTGCAAGATCTAATTATTACGGTAGTAGCTACTGG
TTCTTCGATGTCTGGGGCCAAGGGACCACGGTCACCGTCTCCTCAGGTGGAGGCGGTTCAGGCGGAGGTGGCTCTGGC
GGTGGCGGATCGGACATCGAGCTCACTCAGTCTCCAACAATCCTGTCTGCATCTCCAGGGGAGAAGGTCACAATGACT
TGCAGGGCCAGCTCAAGTGTAAATTACATGGACTGGTACCAGAAGAAGCCAGGATCCTCCCCCAAACCCTGGATTTAT
GCCACATCCAACCTGGCTTCTGGAGTCCCTGCTCGCTTCAGTGGCAGTGGGTCTGGGACCTCTTACTCTCTCACAATC
AGCAGAGTGGAGGCTGAAGATGCTGCCACTTATTACTGCCAGCAGTGGAGTTTTAATCCACCCACGTTCGGAGGGGGG
ACAAAGTTGGAAATAAAACGGGCCGCCGCTCATCATCACCATCACCAT

SEQ ID NO. 301

ATGGATTTTCAGGTGCAGATTTTCAGCTTCCTGCTAATCAGTGCCTCAGTCATAATGTCTAGAGACATCGAGCTCACT
CAGTCTCCAACAATCCTGTCTGCATCTCCAGGGGAGAAGGTCACAATGACTTGCAGGGCCAGCTCAAGTGTAAATTAC

-continued
ATGGACTGGTACCAGAAGAAGCCAGGATCCTCCCCCAAACCCTGGATTTATGCCACATCCAACCTGGCTTCTGGAGTC
CCTGCTCGCTTCAGTGGCAGTGGGTCTGGGACCTCTTACTCTCTCACAATCAGCAGAGTGGAGGCTGAAGATGCTGCC
ACTTATTACTGCCAGCAGTGGAGTTTTAATCCACCCACGTTCGGAGGGGGACAAAGTTGGAAATAAAACGGGGTGGA
GGCGGTTCAGGCGGAGGTGGCTCTGGCGGTGGCGGATCGATGGCCCAGGTCAAACTACAGGAGTCAGGGGCTGAGCTG
GTGAAGCCTGGGGCCTCAGTGAAGATGTCCTGCAAGGCTTCTGGCTACACATTTACCAGTTACAATATGCACTGGGTA
AAGCAGACACCTGGACAGGGCCTGGAATGGATTGGAGCTATTTATCCAGGAAATGGTGATACTTCCTACAATCAGAAG
TTCAAAGGCAAGGCCACATTGACTGCAGACAAATCCTCCAGCACAGCCTACATGCAGCTCAGCAGCCTGACATCTGAG
GACTCTGCGGACTATTACTGTGCAAGATCTAATTATTACGGTAGTAGCTACTGGTTCTTCGATGTCTGGGGCCAAGGG
ACCACGGTCACCGTCTCCTCAGCCGCCGCTGGTGATCCCGCCGAGCCCAAATCTCCTGACAAAACTCACACATGCCCA
CCGTGCCCAGCACCTGAACTCCTGGGGGGACCGTCAGTCTTCCTCTTCCCCCCAAAACCCAAGGACACCCTCATGATC
TCCCGGACCCCTGAGGTCACATGCGTGGTGGTGGACGTGAGCCACGAAGACCCTGAGGTCAAGTTCAACTGGTACGTG
GACGGCGTGGAGGTGCATAATGCCAAGACAAAGCCGCGGGAGGAGCAGTACAACAGCACGTACCGTGTGGTCAGCGTC
CTCACCGTCCTGCACCAGGACTGGCTGAATGGCAAGGAGTACAAGTGCAAGGTCTCCAACAAAGCCCTCCCAGCCCCC
ATCGAGAAAACCATCTCCAAAGCCAAAGGGCAGCCCCGAGAACCACAGGTGTACACCCTGCCCCCATCCCGGGAGGAG
ATGACCAAGAACCAGGTCAGCCTGACCTGCCTGGTCAAAGGCTTCTATCCCAGCGACATCGCCGTGGAGTGGGAGAGC
AATGGGCAGCCGGAGAACAACTACAAGACCACGCCTCCCGTGCTGGACTCCGACGGCTCCTTCTTCCTCTACAGCAAG
CTCACCGTGGACAAGAGCAGGTGGCAGCAGGGGAACGTCTTCTCATGCTCCGTGATGCACGAGGCTCTGCACAACCAC
TACACGCAGAAGAGCCTCTCCCTGTCTCCGGGT SEQ ID NO. 302
ATGGATTTTCAGGTGCAGATTTTCAGCTTCCTGCTAATCAGTGCCTCAGTCATAATGTCTAGAGACATCGAGCTCACT
CAGTCTCCAACAATCCTGTCTGCATCTCCAGGGGAGAAGGTCACAATGACTTGCAGGGCCAGCTCAAGTGTAAATTAC
ATGGACTGGTACCAGAAGAAGCCAGGATCCTCCCCCAAACCCTGGATTTATGCCACATCCAACCTGGCTTCTGGAGTC
CCTGCTCGCTTCAGTGGCAGTGGGTCTGGGACCTCTTACTCTCTCACAATCAGCAGAGTGGAGGCTGAAGATGCTGCC
ACTTATTACTGCCAGCAGTGGAGTTTTAATCCACCCACGTTCGGAGGGGGACAAAGTTGGAAATAAAACGGGGTGGA
GGCGGTTCAGGCGGAGGTGGCTCTGGCGGTGGCGGATCGATGGCCCAGGTCAAACTACAGGAGTCAGGGGCTGAGCTG
GTGAAGCCTGGGGCCTCAGTGAAGATGTCCTGCAAGGCTTCTGGCTACACATTTACCAGTTACAATATGCACTGGGTA
AAGCAGACACCTGGACAGGGCCTGGAATGGATTGGAGCTATTTATCCAGGAAATGGTGATACTTCCTACAATCAGAAG
TTCAAAGGCAAGGCCACATTGACTGCAGACAAATCCTCCAGCACAGCCTACATGCAGCTCAGCAGCCTGACATCTGAG
GACTCTGCGGACTATTACTGTGCAAGATCTAATTATTACGGTAGTAGCTACTGGTTCTTCGATGTCTGGGGCCAAGGG
ACCACGGTCACCGTCTCCTCAGCCGCCGCTCATCATCACCATCACCAT SEQ ID NO. 303
ATGGAGTTTGGGCTGAGCTGGGTTTTCCTCGTTGCTCTTTTTAGAGGTGTCCAGTGTGAGGTGCAGCTGGTGGAGTCT
GGTGGTGGTCTTGTTCAACCTGGTGGTTCTCTTCGTCTTTCTTGTGCTGCTTCTGGTTTTAATATTAAAGATACTTAT
ATTCATTGGGTTCGTCAAGCTCCTGGTAAAGGTCTTGAATGGGTTGCTCGTATTTATCCTACTAATGGTTATACTCGT
TATGCTGATTCTGTTAAAGGTCGTTTTACTATTTCTGCTGATACTTCTAAAAATACTGCTTATCTTCAAATGAACTCT
CTTCGTGCTGAAGATACTGCTGTTTATTATTGTTCTCGTGGGGTGGTGATGGTTTTATGCTATGGATTATTGGGGT
CAAGGTACTCTTGTCACCGTCTCCTCAGCTAGCACCGGGGGAGGTGGGTCTGGAGGTGGAGGATCTGGTGGAGGTGGG
TCTGACATCCAGATGACCCAGTCTCCTTCTTCTCTTTCTGCTTCTGTTGGTGATCGTGTTACTATTACTTGTCGTGCT
TCTCAAGATGTTAATACTGCTGTTGCTTGGTATCAACAAAAACCTGGTAAAGCTCCTAAACTTCTTATTTATTCTGCT
TCTTTTCTTTATTCTGGTGTTCCTTCTCGTTTTTCTGGTTCTCGTTCTGGTACTGATTTTACTCTTACTATTTCTTCT
CTTCAACCTGAAGATTTTGCTACTTATTATTGTCAACAACATTATACTACTCCTCCTACTTTTGGTCAAGGTACCAAG
GTGGAGATCAAACGTACGGACAAAACTCACACATGCCCACCGTGCCCAGCACCTGAACTCCTGGGGGGACCGTCAGTC -continued

```
TTCCTCTTCCCCCCAAAACCCAAGGACACCCTCATGATCTCCCGGACCCCTGAGGTCACATGCGTGGTGGTGGACGTG
AGCCACGAAGACCCTGAGGTCAAGTTCAACTGGTACGTGGACGGCGTGGAGGTGCATAATGCCAAGACAAAGCCGCGG
GAGGAGCAGTACAACAGCACGTACCGTGTGGTCAGCGTCCTCACCGTCCTGCACCAGGACTGGCTGAATGGCAAGGAG
TACAAGTGCAAGGTCTCCAACAAAGCCCTCCCAGCCCCCATCGAGAAAACCATCTCCAAAGCCAAAGGGCAGCCCCGA
GAACCACAGGTGTACACCCTGCCCCCATCCCGGGAGGAGATGACCAAGAACCAGGTCAGCCTGACCTGCCTGGTCAAA
GGCTTCTATCCCAGCGACATCGCCGTGGAGTGGGAGAGCAATGGGCAGCCGGAGAACAACTACAAGACCACGCCTCCC
GTGCTGGACTCCGACGGCTCCTTCTTCCTCTACAGCAAGCTCACCGTGGACAAGAGCAGGTGGCAGCAGGGGAACGTC
TTCTCATGCTCCGTGATGCACGAGGCTCTGCACAACCACTACACGCAGAAGAGCCTCTCCCTGTCTCCGGGT
```

SEQ ID NO. 304
```
ATGCCACCTCCTCGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCAGCAGCTGACCTGG
TCTCGGGAGTCCCCGCTTAAACCCTTCTTAAAACTCAGCCTGGGGCTGCCAGGCCTGGGAATCCACATGAGGCCCCTG
GCCATCTGGCTTTTCATCTTCAACGTCTCTCAACAGATGGGGGGCTTCTACCTGTGCCAGCCGGGGCCCCCCTCTGAG
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCACCGAGGGACAGCCTGAACCAG
AGCCTCAGCCAGGACCTCACCATGGCCCCTGGCTCCACACTCTGGCTGTCCTGTGGGGTACCCCCTGACTCTGTGTCC
AGGGGCCCCCTCTCCTGGACCCATGTGCACCCCAAGGGGCCTAAGTCATTGCTGAGCCTAGAGCTGAAGGACGATCGC
CCGGCCAGAGATATGTGGGTAATGGAGACGGGTCTGTTGTTGCCCCGGGCCACAGCTCAAGACGCTGGAAAGTATTAT
TGTCACCGTGGCAACCTGACCATGTCATTCCACCTGGAGATCACTGCTCGGCCAGGAGGAGGTGGGTCTGGAGGTGGA
GGATCTGGTGGAGGTGGGTCTGGAGGAGGTGGGTCTGGAGGAGGTGGGTCTGGAGGTGGAGGATCTGGTGGAGGTGGG
TCTATGGCCCAGGTCAAACTACAGGAGTCAGGGGCTGAGCTGGTGAAGCCTGGGGCCTCAGTGAAGATGTCCTGCAAG
GCTTCTGGCTACACATTTACCAGTTACAATATGCACTGGGTAAAGCAGACACCTGGACAGGGCCTGGAATGGATTGGA
GCTATTTATCCAGGAAATGGTGATACTTCCTACAATCAGAAGTTCAAAGGCAAGGCCACATTGACTGCAGACAAATCC
TCCAGCACAGCCTACATGCAGCTCAGCAGCCTGACATCTGAGGACTCTGCGGACTATTACTGTGCAAGATCTAATTAT
TACGGTAGTAGCTACTGGTTCTTCGATGTCTGGGGCCAAGGGACCACGGTCACCGTCTCCTCAGGTGGAGGCGGTTCA
GGCGGAGGTGGCTCTGGCGGTGGCGGATCGGACATCGAGCTCACTCAGTCTCCAACAATCCTGTCTGCATCTCCAGGG
GAGAAGGTCACAATGACTTGCAGGGCCAGCTCAAGTGTAAATTACATGGACTGGTACCAGAAGAAGCCAGGATCCTCC
CCCAAACCCTGGATTTATGCCACATCCAACCTGGCTTCTGGAGTCCCTGCTCGCTTCAGTGGCAGTGGGTCTGGGACC
TCTTACTCTCTCACAATCAGCAGAGTGGAGGCTGAAGATGCTGCCACTTATTACTGCAGCAGTGGAGTTTTAATCCA
CCCACGTTCGGAGGGGGACAAAGTTGGAAATAAAACGGGCCGCCGCTGGTGATCCCGCCGAGCCCAAATCTCCTGAC
AAAACTCACACATGCCCACCGTGCCCAGCACCTGAACTCCTGGGGGGACCGTCAGTCTTCCTCTTCCCCCCAAAACCC
AAGGACACCCTCATGATCTCCCGGACCCCTGAGGTCACATGCGTGGTGGTGGACGTGAGCCACGAAGACCCTGAGGTC
AAGTTCAACTGGTACGTGGACGGCGTGGAGGTGCATAATGCCAAGACAAAGCCGCGGGAGGAGCAGTACAACAGCACG
TACCGTGTGGTCAGCGTCCTCACCGTCCTGCACCAGGACTGGCTGAATGGCAAGGAGTACAAGTGCAAGGTCTCCAAC
AAAGCCCTCCCAGCCCCCATCGAGAAAACCATCTCCAAAGCCAAAGGGCAGCCCCGAGAACCACAGGTGTACACCCTG
CCCCCATCCCGGGAGGAGATGACCAAGAACCAGGTCAGCCTGACCTGCCTGGTCAAAGGCTTCTATCCCAGCGACATC
GCCGTGGAGTGGGAGAGCAATGGGCAGCCGGAGAACAACTACAAGACCACGCCTCCCGTGCTGGACTCCGACGGCTCC
TTCTTCCTCTACAGCAAGCTCACCGTGGACAAGAGCAGGTGGCAGCAGGGGAACGTCTTCTCATGCTCCGTGATGCAC
GAGGCTCTGCACAACCACTACACGCAGAAGAGCCTCTCCCTGTCTCCGGGT
```

-continued

SEQ ID NO. 305
ATGCCACCTCCTCGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCAGCAGCTGACCTGG
TCTCGGGAGTCCCCGCTTAAACCCTTCTTAAAACTCAGCCTGGGGCTGCCAGGCCTGGGAATCCACATGAGGCCCCTG
GCCATCTGGCTTTTCATCTTCAACGTCTCTCAACAGATGGGGGCTTCTACCTGTGCCAGCCGGGGCCCCCCTCTGAG
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGACAGCCTGAACCAG
AGCCTCAGCCAGGACCTCACCATGGCCCCTGGCTCCACACTCTGGCTGTCCTGTGGGGTACCCCCTGACTCTGTGTCC
AGGGGCCCCCTCTCCTGGACCCATGTGCACCCCAAGGGGCCTAAGTCATTGCTGAGCCTAGAGCTGAAGGACGATCGC
CCGGCCAGAGATATGTGGGTAATGGAGACGGGTCTGTTGTTGCCCCGGGCCACAGCTCAAGACGCTGGAAAGTATTAT
TGTCACCGTGGCAACCTGACCATGTCATTCCACCTGGAGATCACTGCTCGGCCAGGAGGAGGTGGGTCTGGAGGTGGA
GGATCTGGTGGAGGTGGGTCTGGAGGAGGTGGGTCTGGAGGAGGTGGGTCTGGAGGTGGAGGATCTGGTGGAGGTGGG
TCTATGGCCCAGGTCAAACTACAGGAGTCAGGGGCTGAGCTGGTGAAGCCTGGGGCCTCAGTGAAGATGTCCTGCAAG
GCTTCTGGCTACACATTTACCAGTTACAATATGCACTGGGTAAAGCAGACACCTGGACAGGGCCTGGAATGGATTGGA
GCTATTTATCCAGGAAATGGTGATACTTCCTACAATCAGAAGTTCAAAGGCAAGGCCACATTGACTGCAGACAAATCC
TCCAGCACAGCCTACATGCAGCTCAGCAGCCTGACATCTGAGGACTCTGCGGACTATTACTGTGCAAGATCTAATTAT
TACGGTAGTAGCTACTGGTTCTTCGATGTCTGGGGCCAAGGGACCACGGTCACCGTCTCCTCAGGTGGAGGCGGTTCA
GGCGGAGGTGGCTCTGGCGGTGGCGGATCGGACATCGAGCTCACTCAGTCTCCAACAATCCTGTCTGCATCTCCAGGG
GAGAAGGTCACAATGACTTGCAGGGCCAGCTCAAGTGTAAATTACATGGACTGGTACCAGAAGAAGCCAGGATCCTCC
CCCAAACCCTGGATTTATGCCACATCCAACCTGGCTTCTGGAGTCCCTGCTCGCTTCAGTGGCAGTGGGTCTGGGACC
TCTTACTCTCTCACAATCAGCAGAGTGGAGGCTGAAGATGCTGCCACTTATTACTGCCAGCAGTGGAGTTTTAATCCA
CCCACGTTCGGAGGGGGACAAAGTTGGAAATAAAACGGGCCGCCGCTCATCATCACCATCACCAT

SEQ ID NO. 306
ATGCCACCTCCTCGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCAGCAGCTGACCTGG
TCTCGGGAGTCCCCGCTTAAACCCTTCTTAAAACTCAGCCTGGGGCTGCCAGGCCTGGGAATCCACATGAGGCCCCTG
GCCATCTGGCTTTTCATCTTCAACGTCTCTCAACAGATGGGGGCTTCTACCTGTGCCAGCCGGGGCCCCCCTCTGAG
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGACAGCCTGAACCAG
AGCCTCAGCCAGGACCTCACCATGGCCCCTGGCTCCACACTCTGGCTGTCCTGTGGGGTACCCCCTGACTCTGTGTCC
AGGGGCCCCCTCTCCTGGACCCATGTGCACCCCAAGGGGCCTAAGTCATTGCTGAGCCTAGAGCTGAAGGACGATCGC
CCGGCCAGAGATATGTGGGTAATGGAGACGGGTCTGTTGTTGCCCCGGGCCACAGCTCAAGACGCTGGAAAGTATTAT
TGTCACCGTGGCAACCTGACCATGTCATTCCACCTGGAGATCACTGCTCGGCCAGATCCCGCCGAGCCCAAATCTCCT
GACAAAACTCACACATGCCCACCGTGCCCAGCACCTGAACTCCTGGGGGGACCGTCAGTCTTCCTCTTCCCCCCAAAA
CCCAAGGACACCCTCATGATCTCCCGGACCCCTGAGGTCACATGCGTGGTGGTGGACGTGAGCCACGAAGACCCTGAG
GTCAAGTTCAACTGGTACGTGGACGGCGTGGAGGTGCATAATGCCAAGACAAAGCCGCGGGAGGAGCAGTACAACAGC
ACGTACCGTGTGGTCAGCGTCCTCACCGTCCTGCACCAGGACTGGCTGAATGGCAAGGAGTACAAGTGCAAGGTCTCC
AACAAAGCCCTCCCAGCCCCCATCGAGAAAACCATCTCCAAAGCCAAAGGGCAGCCCCGAGAACCACAGGTGTACACC
CTGCCCCCATCCCGGGAGGAGATGACCAAGAACCAGGTCAGCCTGACCTGCCTGGTCAAAGGCTTCTATCCCAGCGAC

-continued

ATCGCCGTGGAGTGGGAGAGCAATGGGCAGCCGGAGAACAACTACAAGACCACGCCTCCCGTGCTGGACTCCGACGGC

TCCTTCTTCCTCTACAGCAAGCTCACCGTGGACAAGAGCAGGTGGCAGCAGGGGAACGTCTTCTCATGCTCCGTGATG

CACGAGGCTCTGCACAACCACTACACGCAGAAGAGCCTCTCCCTGTCTCCGGGTGGAGGAGGTGGGTCTGGAGGTGGA

GGATCTGGTGGAGGTGGGTCTGGAGGAGGTGGGTCTATGGCCCAGGTCAAACTACAGGAGTCAGGGGCTGAGCTGGTG

AAGCCTGGGGCCTCAGTGAAGATGTCCTGCAAGGCTTCTGGCTACACATTTACCAGTTACAATATGCACTGGGTAAAG

CAGACACCTGGACAGGGCCTGGAATGGATTGGAGCTATTTATCCAGGAAATGGTGATACTTCCTACAATCAGAAGTTC

AAAGGCAAGGCCACATTGACTGCAGACAAATCCTCCAGCACAGCCTACATGCAGCTCAGCAGCCTGACATCTGAGGAC

TCTGCGGACTATTACTGTGCAAGATCTAATTATTACGGTAGTAGCTACTGGTTCTTCGATGTCTGGGGCCAAGGGACC

ACGGTCACCGTCTCCTCAGGTGGAGGCGGTTCAGGCGGAGGTGGCTCTGGCGGTGGCGGATCGGACATCGAGCTCACT

CAGTCTCCAACAATCCTGTCTGCATCTCCAGGGGAGAAGGTCACAATGACTTGCAGGGCCAGCTCAAGTGTAAATTAC

ATGGACTGGTACCAGAAGAAGCCAGGATCCTCCCCCAAACCCTGGATTTATGCCACATCCAACCTGGCTTCTGGAGTC

CCTGCTCGCTTCAGTGGCAGTGGGTCTGGGACCTCTTACTCTCTCACAATCAGCAGAGTGGAGGCTGAAGATGCTGCC

ACTTATTACTGCCAGCAGTGGAGTTTTAATCCACCCACGTTCGGAGGGGGGACAAAGTTGGAAATAAAACGGGCT

SEQ ID NO. 307

ATGGATTTTCAGGTGCAGATTTTCAGCTTCCTGCTAATCAGTGCCTCAGTCATAATGTCTAGAATGGCCCAGGTCAAA

CTACAGGAGTCAGGGGCTGAGCTGGTGAAGCCTGGGGCCTCAGTGAAGATGTCCTGCAAGGCTTCTGGCTACACATTT

ACCAGTTACAATATGCACTGGGTAAAGCAGACACCTGGACAGGGCCTGGAATGGATTGGAGCTATTTATCCAGGAAAT

GGTGATACTTCCTACAATCAGAAGTTCAAAGGCAAGGCCACATTGACTGCAGACAAATCCTCCAGCACAGCCTACATG

CAGCTCAGCAGCCTGACATCTGAGGACTCTGCGGACTATTACTGTGCAAGATCTAATTATTACGGTAGTAGCTACTGG

TTCTTCGATGTCTGGGGCCAAGGGACCACGGTCACCGTCTCCTCAGGTGGAGGCGGTTCAGGCGGAGGTGGCTCTGGC

GGTGGCGGATCGGACATCGAGCTCACTCAGTCTCCAACAATCCTGTCTGCATCTCCAGGGGAGAAGGTCACAATGACT

TGCAGGGCCAGCTCAAGTGTAAATTACATGGACTGGTACCAGAAGAAGCCAGGATCCTCCCCCAAACCCTGGATTTAT

GCCACATCCAACCTGGCTTCTGGAGTCCCTGCTCGCTTCAGTGGCAGTGGGTCTGGGACCTCTTACTCTCTCACAATC

AGCAGAGTGGAGGCTGAAGATGCTGCCACTTATTACTGCCAGCAGTGGAGTTTTAATCCACCCACGTTCGGAGGGGGG

ACAAAGTTGGAAATAAAACGGGCCGCCGCTGGAGGAGGTGGGTCTGGAGGTGGAGGATCTGGTGGAGGTGGGTCTGGA

GGAGGTGGGTCTCCCGAGGAACCTCTAGTGGTGAAGGTGGAAGAGGGAGATAACGCTGTGCTGCAGTGCCTCAAGGGG

ACCTCAGATGGCCCCACTCAGCAGCTGACCTGGTCTCGGGAGTCCCCGCTTAAACCCTTCTTAAAACTCAGCCTGGGG

CTGCCAGGCCTGGGAATCCACATGAGGCCCCTGGCCATCTGGCTTTTCATCTTCAACGTCTCTCAACAGATGGGGGC

TTCTACCTGTGCCAGCCGGGGCCCCCCTCTGAGAAGGCCTGGCAGCCTGGCTGGACAGTCAATGTGGAGGGCAGCGGG

GAGCTGTTCCGGTGGAATGTTTCGGACCTAGGTGGCCTGGGCTGTGGCCTGAAGAACAGGTCCTCAGAGGGCCCCAGC

TCCCCTTCCGGGAAGCTCATGAGCCCCAAGCTGTATGTGTGGGCCAAAGACCGCCCTGAGATCTGGGAGGGAGAGCCT

CCGTGTCTCCCACCGAGGGACAGCCTGAACCAGAGCCTCAGCCAGGACCTCACCATGGCCCCTGGCTCCACACTCTGG

CTGTCCTGTGGGGTACCCCCTGACTCTGTGTCCAGGGGCCCCCTCTCCTGGACCCATGTGCACCCCAAGGGGCCTAAG

TCATTGCTGAGCCTAGAGCTGAAGGACGATCGCCCGGCCAGAGATATGTGGGTAATGGAGACGGGTCTGTTGTTGCCC

CGGGCCACAGCTCAAGACGCTGGAAAGTATTATTGTCACCGTGGCAACCTGACCATGTCATTCCACCTGGAGATCACT

GCTCGGCCAGATCCCGCCGAGCCCAAATCTCCTGACAAAACTCACACATGCCCACCGTGCCCAGCACCTGAACTCCTG

GGGGGACCGTCAGTCTTCCTCTTCCCCCCAAAACCCAAGGACACCCTCATGATCTCCCGGACCCCTGAGGTCACATGC

GTGGTGGTGGACGTGAGCCACGAAGACCCTGAGGTCAAGTTCAACTGGTACGTGGACGGCGTGGAGGTGCATAATGCC

AAGACAAAGCCGCGGGAGGAGCAGTACAACAGCACGTACCGTGTGGTCAGCGTCCTCACCGTCCTGCACCAGGACTGG

CTGAATGGCAAGGAGTACAAGTGCAAGGTCTCCAACAAAGCCCTCCCAGCCCCCATCGAGAAAACCATCTCCAAAGCC

AAAGGGCAGCCCCGAGAACCACAGGTGTACACCCTGCCCCCATCCCGGGAGGAGATGACCAAGAACCAGGTCAGCCTG

-continued

ACCTGCCTGGTCAAAGGCTTCTATCCCAGCGACATCGCCGTGGAGTGGGAGAGCAATGGGCAGCCGGAGAACAACTAC

AAGACCACGCCTCCCGTGCTGGACTCCGACGGCTCCTTCTTCCTCTACAGCAAGCTCACCGTGGACAAGAGCAGGTGG

CAGCAGGGGAACGTCTTCTCATGCTCCGTGATGCACGAGGCTCTGCACAACCACTACACGCAGAAGAGCCTCTCCCTG

TCTCCGGGT

SEQ ID NO. 308
ATGCTCAGGCTGCTCTTGGCTCTCAACTTATTCCCTTCAATTCAAGTAACAGGAGACATCCAGATGACACAGACTACA

TCCTCCCTGTCTGCCTCTCTGGGAGACAGAGTCACCATCAGTTGCAGGGCAAGTCAGGACATTAGTAAATATTTAAAT

TGGTATCAGCAGAAACCAGATGGAACTGTTAAACTCCTGATCTACCATACATCAAGATTACACTCAGGAGTCCCATCA

AGGTTCAGTGGCAGTGGGTCTGGAACAGATTATTCTCTCACCATTAGCAACCTGGAGCAAGAAGATATTGCCACTTAC

TTTTGCCAACAGGGTAATACGCTTCCGTACACGTTCGGAGGGGGACTAAGTTGGAAATAACAGGAGGAGGTGGGTCT

GGAGGTGGAGGATCTGGTGGAGGTGGGTCTGGAGGAGGTGGGTCTGAGGTGAAACTGCAGGAGTCAGGACCTGGCCTG

GTGGCGCCCTCACAGAGCCTGTCCGTCACATGCACTGTCTCAGGGGTCTCATTACCCGACTATGGTGTAAGCTGGATT

CGCCAGCCTCCACGAAAGGGTCTGGAGTGGCTGGGAGTAATATGGGGTAGTGAAACCACATACTATAATTCAGCTCTC

AAATCCAGACTGACCATCATCAAGGACAACTCCAAGAGCCAAGTTTTCTTAAAAATGAACAGTCTGCAAACTGATGAC

ACAGCCATTTACTACTGTGCCAAACATTATTACTACGGTGGTAGCTATGCTATGGACTACTGGGGTCAAGGAACCTCA

GTCACCGTCTCCTCAGACTACAAAGACGATGACGACAAGATTGAAGTTATGTATCCTCCTCCTTACCTAGACAATGAG

AAGAGCAATGGAACCATTATCCATGTGAAAGGGAAACACCTTTGTCCAAGTCCCCTATTTCCCGGACCTTCTAAGCCC

TTTTGGGTGCTGGTGGTGGTTGGTGGAGTCCTGGCTTGCTATAGCTTGCTAGTAACAGTGGCCTTTATTATTTTCTGG

GTGAGGAGTAAGAGGAGCAGGCTCCTGCACAGTGACTACATGAACATGACTCCCCGCCGCCCCGGGCCCACCCGCAAG

CATTACCAGCCCTATGCCCCACCACGCGACTTCGCAGCCTATCGCTCCAAACGGGGCAGAAAGAAACTCCTGTATATA

TTCAAACAACCATTTATGAGACCAGTACAAACTACTCAAGAGGAAGATGGCTGTAGCTGCCGATTTCCAGAAGAAGAA

GAAGGAGGATGTGAACTGAGAGTGAAGTTCAGCAGGAGCGCAGACGCCCCCGCGTACCAGCAGGGCCAGAACCAGCTC

TATAACGAGCTCAATCTAGGACGAAGAGAGGAGTACGATGTTTTGGACAAGAGACGTGGCCGGGACCCTGAGATGGGG

GGAAAGCCGCAGAGAAGGAAGAACCCTCAGGAAGGCCTGTACAATGAACTGCAGAAAGATAAGATGGCGGAGGCCTAC

AGTGAGATTGGGATGAAAGGCGAGCGCCGGAGGGGCAAGGGGCACGATGGCCTTTACCAGGGTCTCAGTACAGCCACC

AAGGACACCTACGACGCCCTTCACATGCAGGCCCTGCCCCCTCGCGAGGGCAGAGGAAGTCTTCTAACATGCGGTGAC

GTGGAGGAGAATCCCGGCCCTATGCCACCTCCTCGCCTCCTCTTCTTCCTCCTCTTCCTCACCCCCATGGAAGTCAGG

CCCGAGGAACCTCTAGTGGTGAAGGTGGAAGAGGGAGATAACGCTGTGCTGCAGTGCCTCAAGGGGACCTCAGATGGC

CCCACTCAGCAGCTGACCTGGTCTCGGGAGTCCCCGCTTAAACCCTTCTTAAAACTCAGCCTGGGGCTGCCAGGCCTG

GGAATCCACATGAGGCCCCTGGCCATCTGGCTTTTCATCTTCAACGTCTCTCAACAGATGGGGGCTTCTACCTGTGC

CAGCCGGGGCCCCCCTCTGAGAAGGCCTGGCAGCCTGGCTGGACAGTCAATGTGGAGGGCAGCGGGGAGCTGTTCCGG

TGGAATGTTTCGGACCTAGGTGGCCTGGGCTGTGGCCTGAAGAACAGGTCCTCAGAGGGCCCCAGCTCCCCTTCCGGG

AAGCTCATGAGCCCCAAGCTGTATGTGTGGGCCAAAGACCGCCCTGAGATCTGGGAGGGAGAGCCTCCGTGTCTCCCA

CCGAGGGACAGCCTGAACCAGAGCCTCAGCCAGGACCTCACCATGGCCCCTGGCTCCACACTCTGGCTGTCCTGTGGG

GTACCCCCTGACTCTGTGTCCAGGGGCCCCCTCTCCTGGACCCATGTGCACCCCAAGGGGCCTAAGTCATTGCTGAGC

CTAGAGCTGAAGGACGATCGCCCGGCCAGAGATATGTGGGTAATGGAGACGGGTCTGTTGTTGCCCCGGGCCACAGCT

CAAGACGCTGGAAAGTATTATTGTCACCGTGGCAACCTGACCATGTCATTCCACCTGGAGATCACTGCTCGGCCAGGG

GGAGGTGGGTCTGGAGGTGGAGGATCTGGTGGAGGTGGGTCTGGTGGAGGTGGGTCTGAGGTGCAGCTGGTGGAGTCT

GGTGGTGGTCTTGTTCAACCTGGTGGTTCTCTTCGTCTTTCTTGTGCTGCTTCTGGTTTTAATATTAAGATACTTAT

ATTCATTGGGTTCGTCAAGCTCCTGGTAAAGGTCTTGAATGGGTTGCTCGTATTTATCCTACTAATGGTTATACTCGT

TATGCTGATTCTGTTAAAGGTCGTTTTACTATTTCTGCTGATACTTCTAAAAATACTGCTTATCTTCAAATGAACTCT

-continued

CTTCGTGCTGAAGATACTGCTGTTTATTATTGTTCTCGTTGGGGTGGTGATGGTTTTTATGCTATGGATTATTGGGGT
CAAGGTACTCTTGTCACCGTCTCCTCAGCTAGCACCGGGGGAGGTGGGTCTGGAGGTGGAGGATCTGGTGGAGGTGGG
TCTGACATCCAGATGACCCAGTCTCCTTCTTCTCTTTCTGCTTCTGTTGGTGATCGTGTTACTATTACTTGTCGTGCT
TCTCAAGATGTTAATACTGCTGTTGCTTGGTATCAACAAAAACCTGGTAAAGCTCCTAAACTTCTTATTTATTCTGCT
TCTTTTCTTTATTCTGGTGTTCCTTCTCGTTTTTCTGGTTCTCGTTCTGGTACTGATTTTACTCTTACTATTTCTTCT
CTTCAACCTGAAGATTTTGCTACTTATTATTGTCAACAACATTATACTACTCCTCCTACTTTTGGTCAAGGTACCAAG
GTGGAGATCAAACGTACGTCTAGACATCATCACCATCACCAT

SEQ ID NO. 309
ATGCCACCTCCTCGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCAGCAGCTGACCTGG
TCTCGGGAGTCCCCGCTTAAACCCTTCTTAAAACTCAGCCTGGGGCTGCCAGGCCTGGGAATCCACATGAGGCCCCTG
GCCATCTGGCTTTTCATCTTCAACGTCTCTCAACAGATGGGGGGCTTCTACCTGTGCCAGCCGGGGCCCCCCTCTGAG
AAGGCCTGGCAGCCTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGACAGCCTGAACCAG
AGCCTCAGCCAGGACCTCACCATGGCCCCTGGCTCCACACTCTGGCTGTCCTGTGGGGTACCCCCTGACTCTGTGTCC
AGGGGCCCCCTCTCCTGGACCCATGTGCACCCCAAGGGGCCTAAGTCATTGCTGAGCCTAGAGCTGAAGGACGATCGC
CCGGCCAGAGATATGTGGGTAATGGAGACGGGTCTGTTGTTGCCCCGGGCCACAGCTCAAGACGCTGGAAAGTATTAT
TGTCACCGTGGCAACCTGACCATGTCATTCCACCTGGAGATCACTGCTCGGCCAGGGGAGGTGGGTCTGGAGGTGGA
GGATCTGGTGGAGGTGGGTCTGGTGGAGGTGGGTCTGAGGTGCAGCTGGTGGAGTCTGGTGGTGGTCTTGTTCAACCT
GGTGGTTCTCTTCGTCTTTCTTGTGCTGCTTCTGGTTTTAATATTAAAGATACTTATATTCATTGGGTTCGTCAAGCT
CCTGGTAAAGGTCTTGAATGGGTTGCTCGTATTTATCCTACTAATGGTTATACTCGTTATGCTGATTCTGTTAAAGGT
CGTTTTACTATTTCTGCTGATACTTCTAAAAATACTGCTTATCTTCAAATGAACTCTCTTCGTGCTGAAGATACTGCT
GTTTATTATTGTTCTCGTTGGGGTGGTGATGGTTTTTATGCTATGGATTATTGGGGTCAAGGTACTCTTGTCACCGTC
TCCTCAGCTAGCACCGGGGGAGGTGGGTCTGGAGGTGGAGGATCTGGTGGAGGTGGGTCTGACATCCAGATGACCCAG
TCTCCTTCTTCTCTTTCTGCTTCTGTTGGTGATCGTGTTACTATTACTTGTCGTGCTTCTCAAGATGTTAATACTGCT
GTTGCTTGGTATCAACAAAAACCTGGTAAAGCTCCTAAACTTCTTATTTATTCTGCTTCTTTTCTTTATTCTGGTGTT
CCTTCTCGTTTTTCTGGTTCTCGTTCTGGTACTGATTTTACTCTTACTATTTCTTCTCTTCAACCTGAAGATTTTGCT
ACTTATTATTGTCAACAACATTATACTACTCCTCCTACTTTTGGTCAAGGTACCAAGGTGGAGATCAAACGTACGTCT
AGACATCATCACCATCACCATGAGGGCAGAGGAAGTCTTCTAACATGCGGTGACGTGGAGGAGAATCCCGGCCCTATG
CTCAGGCTGCTCTTGGCTCTCAACTTATTCCCTTCAATTCAAGTAACAGGAGACATCCAGATGACACAGACTACATCC
TCCCTGTCTGCCTCTCTGGGAGACAGAGTCACCATCAGTTGCAGGGCAAGTCAGGACATTAGTAAATATTTAAATTGG
TATCAGCAGAAACCAGATGGAACTGTTAAACTCCTGATCTACCATACATCAAGATTACACTCAGGAGTCCCATCAAGG
TTCAGTGGCAGTGGGTCTGAACAGATTATTCTCACCATTAGCAACCTGGAGCAAGAAGATATTGCCACTTACTTT
TGCCAACAGGGTAATACGCTTCCGTACACGTTCGGAGGGGGGACTAAGTTGGAAATAACAGGAGGAGGTGGGTCTGGA
GGTGGAGGATCTGGTGGAGGTGGGTCTGGAGGAGGTGGGTCTGAGGTGAAACTGCAGGAGTCAGGACCTGGCCTGGTG
GCGCCCTCACAGAGCCTGTCCGTCACATGCACTGTCTCAGGGGTCTCATTACCCGACTATGGTGTAAGCTGGATTCGC
CAGCCTCCACGAAAGGGTCTGGAGTGGCTGGGAGTAATATGGGGTAGTGAAACCACATACTATAATTCAGCTCTCAAA
TCCAGACTGACCATCATCAAGGACAACTCCAAGAGCCAAGTTTTCTTAAAAATGAACAGTCTGCAAACTGATGACACA
GCCATTTACTACTGTGCCAAACATTATTACTACGGTGGTAGCTATGCTATGGACTACTGGGGTCAAGGAACCCTCAGTC
ACCGTCTCCTCAGACTACAAAGACGATGACGACAAGATTGAAGTTATGTATCCTCCTCCTTACCTAGACAATGAGAAG

-continued

AGCAATGGAACCATTATCCATGTGAAAGGGAAACACCTTTGTCCAAGTCCCCTATTTCCCGGACCTTCTAAGCCCTTT

TGGGTGCTGGTGGTGGTTGGTGGAGTCCTGGCTTGCTATAGCTTGCTAGTAACAGTGGCCTTTATTATTTTCTGGGTG

AGGAGTAAGAGGAGCAGGCTCCTGCACAGTGACTACATGAACATGACTCCCCGCCGCCCCGGGCCCACCCGCAAGCAT

TACCAGCCCTATGCCCCACCACGCGACTTCGCAGCCTATCGCTCCAAACGGGGCAGAAAGAAACTCCTGTATATATTC

AAACAACCATTTATGAGACCAGTACAAACTACTCAAGAGGAAGATGGCTGTAGCTGCCGATTTCCAGAAGAAGAAGAA

GGAGGATGTGAACTGAGAGTGAAGTTCAGCAGGAGCGCAGACGCCCCCGCGTACCAGCAGGGCCAGAACCAGCTCTAT

AACGAGCTCAATCTAGGACGAAGAGAGGAGTACGATGTTTTGGACAAGAGACGTGGCCGGGACCCTGAGATGGGGGGA

AAGCCGCAGAGAAGGAAGAACCCTCAGGAAGGCCTGTACAATGAACTGCAGAAAGATAAGATGGCGGAGGCCTACAGT

GAGATTGGGATGAAAGGCGAGCGCCGGAGGGGCAAGGGGCACGATGGCCTTTACCAGGGTCTCAGTACAGCCACCAAG

GACACCTACGACGCCCTTCACATGCAGGCCCTGCCCCCTCGC

SEQ ID NO. 310

GATATCGAATTAGGAGGAAAACTGTTTCATACAGAAGGCGTCAATTAGGAGGAAAAACTGTTTCATACAGAAGGCGTC

AATTAGGAGGAAAAACTGTTTCATACAGAAGGCGTCAATTGGTCCCATCGAATTAGGAGGAAAAACTGTTTCATACAG

AAGGCGTCAATTAGGAGGAAAAACTGTTTCATACAGAAGGCGTCAATTAGGAGGAAAAACTGTTTCATACAGAAGGCG

TCAATTGGTCCCGGGACATTTTGACACCCCCATAATATTTTTCCAGAATTAACAGTATAAATTGCATCTCTTGTTCAA

GAGTTCCCTATCACTCTCTTTAATCACTACTCACAGTAACCTCAACTCCTGGCGGCCGCGCCACCATGCCACCTCCTC

GCCTCCTCTTCTTCCTCCTCTTCCTCACCCCCATGGAAGTCAGGCCCGAGGAACCTCTAGTGGTGAAGGTGGAAGAGG

GAGATAACGCTGTGCTGCAGTGCCTCAAGGGGACCTCAGATGGCCCCACTCAGCAGCTGACTTGGTCTCGGGAGTCCC

CGCTTAAACCCTTCTTAAAACTCAGCCTGGGGCTGCCAGGCCTGGGAATCCACATGAGGCCCCTGGCCATCTGGCTTT

TCATCTTCAACGTCTCTCAACAGATGGGGGCTTCTACCTGTGCCAGCCGGGCCCCCCTCTGAGAAGGCCTGGCAGC

CTGGCTGGACAGTCAATGTGGAGGCAGCGGGGAGCTGTTCCGGTGGAATGTTTCGGACCTAGGTGGCCTGGGCTGTG

GCCTGAAGAACAGGTCCTCAGAGGGCCCCAGCTCCCCTTCCGGGAAGCTCATGAGCCCCAAGCTGTATGTGTGGGCCA

AAGACCGCCCTGAGATCTGGGAGGGAGAGCCTCCGTGTCTCCCACCGAGGGACAGCCTGAACCAGAGCCTCAGCCAGG

ACCTCACCATGGCCCCTGGCTCCACACTCTGGCTGTCCTGTGGGGTACCCCCTGACTCTGTGTCCAGGGGCCCCCTCT

CCTGGACCCATGTGCACCCCAAGGGGCCTAAGTCATTGCTGAGCCTAGAGCTGAAGGACGATCGCCCGGCCAGAGATA

TGTGGGTAATGGAGACGGGTCTGTTGTTGCCCCGGGCCACAGCTCAAGACGCTGGAAAGTATTATTGTCACCGTGGCA

ACCTGACCATGTCATTCCACCTGGAGATCACTGCTCGGCCAGGGGAGGTGGGTCTGGAGGTGGAGGATCTGGTGGAG

GTGGGTCTGGTGGAGGTGGGTCTGAGGTGCAGCTGGTGGAGTCTGGTGGTGGTCTTGTTCAACCCGGTGGTTCTCTTC

GTCTTTCTTGTGCTGCTTCTGGTTTTAATATTAAAGATACTTATATTCATTGGGTTCGTCAAGCTCCTGGTAAAGGTC

TTGAATGGGTTGCTCGTATTTATCCTACTAATGGTTATACTCGTTATGCTGATTCTGTTAAAGGTCGTTTTACTATTT

CTGCTGATACTTCTAAAAATACTGCTTATCTTCAAATGAACTCTCTTCGTGCTGAAGATACTGCTGTTTATTATTGTT

CTCGTTGGGGTGGTGATGGTTTTTATGCTATGGATTATTGGGGTCAAGGTACTCTTGTCACCGTCTCCTCAGCTAGCA

CCGGGGGAGGTGGGTCTGGAGGTGGAGGATCTGGTGGAGGTGGGTCTGACATCCAGATGACCCAGTCTCCTTCTTCTC

TTTCTGCTTCTGTTGGTGATCGTGTTACTATTACTTGTCGTGCTTCTCAAGATGTTAATACTGCTGTTGCTTGGTATC

AACAAAAACCCGGTAAAGCTCCTAAACTTCTTATTTATTCTGCTTCTTTTCTTTATTCTGGTGTTCCTTCTCGTTTTT

CTGGTTCTCGTTCTGGTACTGATTTTACTCTTACTATTTCTTCTCTTCAACCTGAAGATTTTGCTACTTATTATTGTC

AACAACATTATACTACTCCTCCTACTTTTGGTCAAGGTACCAAGGTGGAGATCAAACGTACGCATCATCACCATCACC

AT

SEQ ID NO. 311

ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

-continued

```
GCCATCTGGCTTTTCATCTTCAACGTCTCTCAACAGATGGGGGCTTCTACCTGTGCCAGCCGGGGCCCCCCTCTGAG

AAGGCCTGGCAGCCTGGCTGGACAGTCAATGTGGAGGGCAGCGGGGAGCTGTTCCGGTGGAATGTTTCGGACCTAGGT

GGCCTGGGCTGTGGCCTGAAGAACAGGTCCTCAGAGGGCCCCAGCTCCCCTTCCGGGAAGCTCATGAGCCCCAAGCTG

TATGTGTGGGCCAAAGACCGCCCTGAGATCTGGGAGGGAGAGCCTCCGTGTCTCCCACCGAGGGACAGCCTGAACCAG

AGCCTCAGCCAGGACCTCACCATGGCCCTGGCTCCACACTCTGGCTGTCCTGTGGGGTACCCCCTGACTCTGTGTCC

AGGGGCCCCCTCTCCTGGACCCATGTGCACCCCAAGGGGCCTAAGTCATTGCTGAGCCTAGAGCTGAAGGACGATCGC

CCGGCCAGAGATATGTGGGTAATGGAGACGGGTCTGTTGTTGCCCCGGGCCACAGCTCAAGACGCTGGAAAGTATTAT

TGTCACCGTGGCAACCTGACCATGTCATTCCACCTGGAGATCACTGCTCGGCCAGGGGGAGGTGGGTCTGGAGGTGGA

GGATCTGGTGGAGGTGGGTCTGGTGGAGGTGGGTCTGAGGTGCAGCTGGTGGAGTCTGGTGGTGGTCTTGTTCAACCT

GGTGGTTCTCTTCGTCTTTCTTGTGCTGCTTCTGGTTTTAATATTAAAGATACTTATATTCATTGGGTTCGTCAAGCT

CCTGGTAAAGGTCTTGAATGGGTTGCTCGTATTTATCCTACTAATGGTTATACTCGTTATGCTGATTCTGTTAAAGGT

CGTTTTACTATTTCTGCTGATACTTCTAAAAATACTGCTTATCTTCAAATGAACTCTCTTCGTGCTGAAGATACTGCT

GTTTATTATTGTTCTCGTTGGGGTGGTGATGGTTTTTATGCTATGGATTATTGGGGTCAAGGTACTCTTGTCACCGTC

TCCTCAGCTAGCACCGGGGGAGGTGGGTCTGGAGGTGGAGGATCTGGTGGAGGTGGGTCTGACATCCAGATGACCCAG

TCTCCTTCTTCTCTTTCTGCTTCTGTTGGTGATCGTGTTACTATTACTTGTCGTGCTTCTCAAGATGTTAATACTGCT

GTTGCTTGGTATCAACAAAAACCTGGTAAAGCTCCTAAACTTCTTATTTATTCTGCTTCTTTTCTTTATTCTGGTGTT

CCTTCTCGTTTTTCTGGTTCTCGTTCTGGTACTGATTTTACTCTTACTATTTCTTCTCTTCAACCTGAAGATTTTGCT

ACTTATTATTGTCAACAACATTATACTACTCCTCCTACTTTTGGTCAAGGTACCAAGGTGGAGATCAAACGTACGCAC

CACCATCACCACCAT
                                                              SEQ ID NO. 312
ATGCCACCTCCTCGCCTCCTCTTCTTCCTCCTCTTCCTCACCCCCATGGAAGTCAGGCCCGAGGAACCTCTAGTGGTG

AAGGTGGAAGAGGGAGATAACGCTGTGCTGCAGTGCCTCAAGGGGACCTCAGATGGCCCCACTCAGCAGCTGACCTGG

TCTCGGGAGTCCCCGCTTAAACCCTTCTTAAAACTCAGCCTGGGGCTGCCAGGCCTGGGAATCCACATGAGGCCCCTG

GCCATCTGGCTTTTCATCTTCAACGTCTCTCAACAGATGGGGGCTTCTACCTGTGCCAGCCGGGGCCCCCCTCTGAG

AAGGCCTGGCAGCCTGGCTGGACAGTCAATGTGGAGGGCAGCGGGGAGCTGTTCCGGTGGAATGTTTCGGACCTAGGT

GGCCTGGGCTGTGGCCTGAAGAACAGGTCCTCAGAGGGCCCCAGCTCCCCTTCCGGGAAGCTCATGAGCCCCAAGCTG

TATGTGTGGGCCAAAGACCGCCCTGAGATCTGGGAGGGAGAGCCTCCGTGTCTCCCACCGAGGGACAGCCTGAACCAG

AGCCTCAGCCAGGACCTCACCATGGCCCTGGCTCCACACTCTGGCTGTCCTGTGGGGTACCCCCTGACTCTGTGTCC

AGGGGCCCCCTCTCCTGGACCCATGTGCACCCCAAGGGGCCTAAGTCATTGCTGAGCCTAGAGCTGAAGGACGATCGC

CCGGCCAGAGATATGTGGGTAATGGAGACGGGTCTGTTGTTGCCCCGGGCCACAGCTCAAGACGCTGGAAAGTATTAT

TGTCACCGTGGCAACCTGACCATGTCATTCCACCTGGAGATCACTGCTCGGCCAGTACTATGGCACTGGCTGCTGAGG

ACTGGTGGCTGGAAG
```

SEQUENCE LISTING (313 sequences)

SEQ ID NO: 1 - protein, 463 aa, Artificial Sequence
  Description of Artificial Sequence: Synthetic polypeptide
MEFGLSWVFLVALFRGVQCQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFQSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 2 - protein, 347 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3 - protein, 577 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGGGGSGGGGSGGGGSQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFQSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 4 - protein, 234 aa, Artificial Sequence
  Description of Artificial Sequence: Synthetic polypeptide
METDTLLLWVLLLWVPGSTGDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5 - protein, 356 aa, Artificial Sequence
  Description of Artificial Sequence: Synthetic polypeptide
METDTLLLWVLLLWVPGSTGDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTSPPSPAPEAAGGPSEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSG

SEQ ID NO: 6 - protein, 581 aa, Artificial Sequence
  Description of Artificial Sequence: Synthetic polypeptide
MEFGLSWVFLVALFRGVQCQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFQSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGSGGGGSGGGGSEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSG

SEQ ID NO: 7 - protein, 460 aa, Artificial Sequence
  Description of Artificial Sequence: Synthetic polypeptide
MEFGLSWVFLVALFRGVQCQVQLVQSGAEVKKPGASVKVSCKASGYTFTDYYMHWVRQAPGQGLEWMGRVNPNRRGTTYNQKFEGRVTMTTDTSTSTAYMELRSLRSDDTAVYYCARANWLDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 8 - protein, 348 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGGGGSGGGGSGGGGSDIQMTQSPSSLSASVGDRVTITCSVSSSVSSIYLHWYQQKPGKAPKLLIYSTSNLASGVPSRFSGSGSGTDFTLTISSLQPEDFATYYCQVYSGYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9 - protein, 573 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGGGGSGGGGSGGGGSQVQLVQSGAEVKKPGASVKVSCKASGYTFTDYYMHWVRQAPGQGLEWMGRVNPNRRGTTYNQKFEGRVTMTTDTSTSTAYMELRSLRSDDTAVYYCARANWLDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSL

SEQ ID NO: 10 - protein, 235 aa, Artificial Sequence
  Description of Artificial Sequence: Synthetic polypeptide
METDTLLLWVLLLWVPGSTGDIQMTQSPSSLSASVGDRVTITCSVSSSVSSIYLHWYQQKPGKAPKLLIYSTSNLASGVPSRFSGSGSGTDFTLTISSLQPEDFATYYCQVYSGYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11 - protein, 357 aa, Artificial Sequence
  Description of Artificial Sequence: Synthetic polypeptide
METDTLLLWVLLLWVPGSTGDIQMTQSPSSLSASVGDRVTITCSVSSSVSSIYLHWYQQKPGKAPKLLIYSTSNLASGVPSRFSGSGSGTDFTLTISSLQPEDFATYYCQVYSGYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTSPPSPAPEAAGGPSEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSG

SEQ ID NO: 12 - protein, 578 aa, Artificial Sequence
  Description of Artificial Sequence: Synthetic polypeptide
MEFGLSWVFLVALFRGVQCQVQLVQSGAEVKKPGASVKVSCKASGYTFTDYYMHWVRQAPGQGLEWMGRVNPNRRGTTYNQKFEGRVTMTTDTSTSTAYMELRSLRSDDTAVYYCARANWLDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSG

SEQ ID NO: 13 - protein, 646 aa, Artificial Sequence
  Description of Artificial Sequence: Synthetic polypeptide
METDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 14 - protein, 125 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGHHHHHH

SEQ ID NO: 15 - protein, 345 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 16 - protein, 274 aa, Artificial Sequence
  Description of Artificial Sequence: Synthetic polypeptide
MEFGLSWVFLVALFRGVQCEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGPHHHHHH

SEQ ID NO: 17 - protein, 280 aa, Artificial Sequence
  Description of Artificial Sequence: Synthetic polypeptide
MEFGLSWVFLVALFRGVQCQVQLVQSGAEDKKPGESVKISCKASGYTFTNYGMNWVRQAPGQGLKWMGWINTYTGESTYADDFKGRFAFSLDTSASTAYLQLSSLRGEDTAVYFCARFAIKGDYWGQGTTVTVSSASTGGGGSGGGGSGGGGSGGGGSDIVMTQSPLSLEVSPGEPASISCRSTKSLLHSDGITYLYWYLQKPGQSPQLLIYQLSNLASGVPDRFSSSGSGTDFTLKISRVEAEDEGTYYCAQNLEIPRTFGQGTKLEIKRTGPHHHHHH

SEQ ID NO: 18 - protein, 278 aa, Artificial Sequence
  Description of Artificial Sequence: Synthetic polypeptide
METDTLLLWVLLLWVPGSTGDIVMTQSPLSLPVTPGEPASISCRSTKSLLHSDGITYLYWYLQKPGQSPQLLIYQLSNLASGVPDRFSSSGSGTDFTLKISRVEAEDEGVYYCAQNLEIPRTFGCGTKLEIKRTGGGGSGGGGSGGGGSGGGGSQVQLVQSGAEVKKPGESVKISCKASGYTFTNYGMNWVRQAPGQCLKWMGWINTYTGESTYADDFKGRFAFSLDTSASTAYLQLSSLRSEDTAVYFCARFAIKGDYWGQGTLVTVSSGPHHHHHH

SEQ ID NO: 19 - protein, 275 aa, Artificial Sequence
  Description of Artificial Sequence: Synthetic polypeptide
MEFGLSWVFLVALFRGVQCQVQLVQSGAEDVKPDASVKLSCKASGYTFTDYYMHWVRQAPGQGLEWMGRVNPNRRGTTYNQKFEGRVTMTTDTSTSTAYMQLSSLRGEDTAVYYCARANWLDYWGQGTTVTVSSASTGGGGSGGGGSGGGGSGGGGSDIQMTQSPSSLEASVGDRVTITCSVSSSVSSIYLHWYQQKPGKSPKLLIYSTSNLASGVPDRFSGSGSGTDFTLTISSLQAEDEGTYYCQVYSGYPLTFGGGTKLEIKRTGPHHHHHH

SEQ ID NO: 20 - protein, 273 aa, Artificial Sequence
  Description of Artificial Sequence: Synthetic polypeptide
METDTLLLWVLLLWVPGSTGDIQMTQSPSSLSASVGDRVTITCSVSSSVSSIYLHWYQQKPGKAPKLLIYSTSNLASGVPSRFSGSGSGTDFTLTISSLQPEDEATYYCQVYSGYPLTFGCGTKVEIKRTGGGGSGGGGSGGGGSGGGGSQVQLVQSGAEDKKPGASVKVSCKASGYTFTDYYMHWVRQAPGQCLEWMGRVNPNRRGTTYNQKFEGRVTMTTDTSTSTAYMELRSLRSDDTAVYYCARANWLDYWGQGTTVTVSSGPHHHHHH

SEQ ID NO: 21 - protein, 278 aa, Artificial Sequence
  Description of Artificial Sequence: Synthetic polypeptide
MEFGLSWVFLVALFRGVQCQVQLQESGPGDVKPSETLSLTCTVSGGSVSSGDYYWTWIRQSPGKGLEWIGHIYYSGNTNYNPSLKSRLTISIDTSKTTFSLQLSSVTGEDTAIYYCVRDRVTGAFDIWGQGTTVTVSSASTGGGGSGGGGSGGGGSGGGGSDIQMTQSPSSLEASVGDRVTITCQASQDISNYLNWYQQKPGKSPKLLIYDASNLETGVPDRFSGSGSGTDFTFTISSLQAEDEGTYFCQHFDHLPLAFGGGTKLEIKRTGPHHHHHH

SEQ ID NO: 22 - protein, 276 aa, Artificial Sequence
  Description of Artificial Sequence: Synthetic polypeptide
METDTLLLWVLLLWVPGSTGDIQMTQSPSSLSASVGDRVTITCQASQDISNYLNWYQQKPGKAPKLLIYDASNLETGVPSRFSGSGSGTDFTFTISSLQPEDEATYFCQHFDHLPLAFGCGTKVEIKRTGGGGSGGGGSGGGGSGGGGSQVQLQESGPGDVKPSETLSLTCTVSGGSVSSGDYYWTWIRQSPGKCLEWIGHIYYSGNTNYNPSLKSRLTISIDTSKTQFSLKLSSVTAADTAIYYCVRDRVTGAFDIWGQGTTVTVSSGPHHHHHH

SEQ ID NO: 23 - protein, 456 aa, Artificial Sequence
  Description of Artificial Sequence: Synthetic polypeptide
MPPPRLLFFLLFLTPMEVRHHHHHHPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 24 - protein, 398 aa, Artificial Sequence
  Description of Artificial Sequence: Synthetic polypeptide
MEFGLSWVFLVALFRGVQCEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTDKTHTSPPSPAPEAAGGPSEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGSRGPHHHHHH

SEQ ID NO: 25 - protein, 614 aa, Artificial Sequence
  Description of Artificial Sequence: Synthetic polypeptide
MEFGLSWVFLVALFRGVQCEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTDKTHTSPPSPAPEAAGGPSEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 26 - protein, 396 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTSRGPHHHHHH

SEQ ID NO: 27 - protein, 612 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 28 - protein, 284 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPHHHHHH

SEQ ID NO: 29 - protein, 504 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 30 - protein, 128 aa, Artificial Sequence
  Description of Artificial Sequence: Synthetic polypeptide
MPPPRLLFFLLFLTPMEVRPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPHHHHHH

SEQ ID NO: 31 - protein, 348 aa, Artificial Sequence
  Description of Artificial Sequence: Synthetic polypeptide
MPPPRLLFFLLFLTPMEVRPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 32 - protein, 507 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 33 - protein, 737 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFQSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 34 - protein, 512 aa, Artificial Sequence
  Description of Artificial Sequence: Synthetic polypeptide
METDTLLLWVLLLWVPGSTGDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTSPPSPAPEAAGGPSPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARP

SEQ ID NO: 35 - protein, 737 aa, Artificial Sequence
  Description of Artificial Sequence: Synthetic polypeptide
MEFGLSWVFLVALFRGVQCQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFQSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGSGGGGSGGGGSPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARP

SEQ ID NO: 36 - protein, 508 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSDIQMTQSPSSLSASVGDRVTITCSVSSSVSSIYLHWYQQKPGKAPKLLIYSTSNLASGVPSRFSGSGSGTDFTLTISSLQPEDFATYYCQVYSGYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 37 - protein, 733 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSQVQLVQSGAEVKKPGASVKVSCKASGYTFTDYYMHWVRQAPGQGLEWMGRVNPNRRGTTYNQKFEGRVTMTTDTSTSTAYMELRSLRSDDTAVYYCARANWLDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSL

SEQ ID NO: 38 - protein, 513 aa, Artificial Sequence
  Description of Artificial Sequence: Synthetic polypeptide
METDTLLLWVLLLWVPGSTGDIQMTQSPSSLSASVGDRVTITCSVSSSVSSIYLHWYQQKPGKAPKLLIYSTSNLASGVPSRFSGSGSGTDFTLTISSLQPEDFATYYCQVYSGYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTSPPSPAPEAAGGPSPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARP

SEQ ID NO: 39 - protein, 734 aa, Artificial Sequence
  Description of Artificial Sequence: Synthetic polypeptide
MEFGLSWVFLVALFRGVQCQVQLVQSGAEVKKPGASVKVSCKASGYTFTDYYMHWVRQAPGQGLEWMGRVNPNRRGTTYNQKFEGRVTMTTDTSTSTAYMELRSLRSDDTAVYYCARANWLDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARP

SEQ ID NO: 40 - protein, 554 aa, Artificial Sequence
  Description of Artificial Sequence: Synthetic polypeptide
MEFGLSWVFLVALFRGVQCEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTDKTHTSPPSPAPEAAGGPSPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPSRGPHHHHHH

SEQ ID NO: 41 - protein, 770 aa, Artificial Sequence
  Description of Artificial Sequence: Synthetic polypeptide
MEFGLSWVFLVALFRGVQCEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTDKTHTSPPSPAPEAAGGPSPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 42 - protein, 555 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTSRGPHHHHHH

SEQ ID NO: 43 - protein, 771 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 44-45 - skipped (2 entries)

SEQ ID NO: 46 - protein, 234 aa, Artificial Sequence
  Description of Artificial Sequence: Synthetic polypeptide
MESDESGLPAMEIECRITGTLNGVEFELVGGGEGTPEQGRMTNKMKSTKGALTFSPYLLSHVMGYGFYHFGTYPSGYENPFLHAINNGGYTNTRIEKYEDGGVLHVSFSYRYEAGRVIGDFKVMGTGFPEDSVIFTDKIIRSNATVEHLHPMGDNDLDGSFTRTFSLRDGGYYSSVVDSHMHFKSAIHPSILQNGGPMFAFRRVEEDHSNTELGIVEYQHAFKTPDADAGEERV

SEQ ID NO: 47 - protein, 234 aa, Artificial Sequence; identical to SEQ ID NO: 46
  Description of Artificial Sequence: Synthetic polypeptide

SEQ ID NO: 48 - protein, 234 aa, Artificial Sequence; identical to SEQ ID NO: 46
  Description of Artificial Sequence: Synthetic polypeptide

SEQ ID NO: 49 - protein, 234 aa, Artificial Sequence; identical to SEQ ID NO: 46
  Description of Artificial Sequence: Synthetic polypeptide

SEQ ID NO: 50 - protein, 755 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKGGGGSGGGGSGGGGSGGGGSQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFQSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 51 - protein, 751 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKGGGGSGGGGSGGGGSGGGGSQVQLVQSGAEVKKPGASVKVSCKASGYTFTDYYMHWVRQAPGQGLEWMGRVNPNRRGTTYNQKFEGRVTMTTDTSTSTAYMELRSLRSDDTAVYYCARANWLDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSL

SEQ ID NO: 52 - protein, 570 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKGGGGSGGGGSGGGGSGGGGSQVQLVQSGAEDKKPGESVKISCKASGYTFTNYGMNWVRQAPGQGLKWMGWINTYTGESTYADDFKGRFAFSLDTSASTAYLQLSSLRGEDTAVYFCARFAIKGDYWGQGTTVTVSSASTGGGGSGGGGSGGGGSGGGGSDIVMTQSPLSLEVSPGEPASISCRSTKSLLHSDGITYLYWYLQKPGQSPQLLIYQLSNLASGVPDRFSSSGSGTDFTLKISRVEAEDEGTYYCAQNLEIPRTFGQGTKLEIKRTHHHHHH

SEQ ID NO: 53 - protein, 565 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKGGGGSGGGGSGGGGSGGGGSQVQLVQSGAEDVKPDASVKLSCKASGYTFTDYYMHWVRQAPGQGLEWMGRVNPNRRGTTYNQKFEGRVTMTTDTSTSTAYMQLSSLRGEDTAVYYCARANWLDYWGQGTTVTVSSASTGGGGSGGGGSGGGGSGGGGSDIQMTQSPSSLEASVGDRVTITCSVSSSVSSIYLHWYQQKPGKSPKLLIYSTSNLASGVPDRFSGSGSGTDFTLTISSLQAEDEGTYYCQVYSGYPLTFGGGTKLEIKRTHHHHHH

SEQ ID NO: 54 - protein, 568 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKGGGGSGGGGSGGGGSGGGGSQVQLQESGPGDVKPSETLSLTCTVSGGSVSSGDYYWTWIRQSPGKGLEWIGHIYYSGNTNYNPSLKSRLTISIDTSKTTFSLQLSSVTGEDTAIYYCVRDRVTGAFDIWGQGTTVTVSSASTGGGGSGGGGSGGGGSGGGGSDIQMTQSPSSLEASVGDRVTITCQASQDISNYLNWYQQKPGKSPKLLIYDASNLETGVPDRFSGSGSGTDFTFTISSLQAEDEGTYFCQHFDHLPLAFGGGTKLEIKRTHHHHHH

SEQ ID NO: 55 - protein, 564 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTHHHHHH

SEQ ID NO: 56 - protein, 784 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRT

SEQ ID NO: 57 - protein, 929 aa, Artificial Sequence
  Description of Artificial Sequence: Synthetic polypeptide
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTGGGGSGGGGSGGGGSGGGGSQVQLQESGPGDVKPSETLSLTCTVSGGSVSSGDYYWTWIRQSPGKGLEWIGHIYYSGNTNYNPSLKSRLTISIDTSKTTFSLQLSSVTGEDTAIYYCVRDRVTGAFDIWGQGTTVTVSSASTGGGGSGGGGSGGGGSGGGGSDIQMTQSPSSLEASVGDRVTITCQASQDISNYLNWYQQKPGKSPKLLIYDASNLETGVPDRFSGSGSGTDFTFTISSLQAEDEGTYFCQHFDHLPLAFGGGTKLEIKRTHHHHHH

SEQ ID NO: 58 - protein, 454 aa, Artificial Sequence
  Description of Artificial Sequence: Synthetic polypeptide
MELAALCRWGLLLALLPPGAASNRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTGGGGSGGGGSGGGGSGGGGSQVQLQESGPGDVKPSETLSLTCTVSGGSVSSGDYYWTWIRQSPGKGLEWIGHIYYSGNTNYNPSLKSRLTISIDTSKTTFSLQLSSVTGEDTAIYYCVRDRVTGAFDIWGQGTTVTVSSASTGGGGSGGGGSGGGGSGGGGSDIQMTQSPSSLEASVGDRVTITCQASQDISNYLNWYQQKPGKSPKLLIYDASNLETGVPDRFSGSGSGTDFTFTISSLQAEDEGTYFCQHFDHLPLAFGGGTKLEIKRTHHHHHH

SEQ ID NO: 59-62 - skipped (4 entries)

SEQ ID NO: 63 - protein, 563 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKGGGGSGGGGSGGGGSGGGGSEVQLQQSGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGAGTTVTVSSGSTSGGGSGGGSGGGGSSDIVLTQSPAILSASPGEKVTMTCRASSSVNYMDWYQKKPGSSPKPWIYATSNLASGVPARFSGSGSGTSYSLTISRVEAEDAATYYCQQWSFNPPTFGGGTKLEIKHHHHHH

SEQ ID NO: 64 - protein, 605 aa, Artificial Sequence
  Description of Artificial Sequence: Synthetic polypeptide
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKACTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEGGGGSGGGGSGGGGSGGGGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSHHHHHH

SEQ ID NO: 65 - protein, 604 aa, Artificial Sequence
  Description of Artificial Sequence: Synthetic polypeptide
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKACTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEGGGGSGGGGSGGGGSGGGGSEVQLQQSGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGAGTTVTVSSGSTSGGGSGGGSGGGGSSDIVLTQSPAILSASPGEKVTMTCRASSSVNYMDWYQKKPGSSPKPWIYATSNLASGVPARFSGSGSGTSYSLTISRVEAEDAATYYCQQWSFNPPTFGGGTKLEIKHHHHHH

SEQ ID NO: 66 - skipped

SEQ ID NO: 67 - protein, 579 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKGGGGSGGGGSGGGGSGGGGSDILMTQSPSSMSVSLGDTVSITCHSSQDINSNIGWLQQRPGKSFKGLIYHGTNLDDEVPSRFSGSGSGADYSLTISSLESEDFADYYCVQYAQFPWTFGGGTKLEIKRGGGGSGGGGSGGGGSGGGGSMRVLILLWLFTAFPGVLSDVQLQESGPSLVKPSQSLSLTCTVTGYSITSDFAWNWIRQFPGNKLEWMGYISYSGNTRYNPSLKSRISITRDTSKNQFFLQLNSVTIEDTATYYCVTAGRGFPYWGQGTLVTVSAHHHHHH

SEQ ID NO: 68 - protein, 620 aa, Artificial Sequence
  Description of Artificial Sequence: Synthetic polypeptide
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKACTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEGGGGSGGGGSGGGGSGGGGSDILMTQSPSSMSVSLGDTVSITCHSSQDINSNIGWLQQRPGKSFKGLIYHGTNLDDEVPSRFSGSGSGADYSLTISSLESEDFADYYCVQYAQFPWTFGGGTKLEIKRGGGGSGGGGSGGGGSGGGGSMRVLILLWLFTAFPGVLSDVQLQESGPSLVKPSQSLSLTCTVTGYSITSDFAWNWIRQFPGNKLEWMGYISYSGNTRYNPSLKSRISITRDTSKNQFFLQLNSVTIEDTATYYCVTAGRGFPYWGQGTLVTVSAHHHHHH

SEQ ID NO: 69-70 - skipped (2 entries)

SEQ ID NO: 71 - protein, 535 aa, Artificial Sequence
  Description of Artificial Sequence: Synthetic polypeptide
MLRLLLALNLFPSIQVTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDYKDDDDKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 72 - protein, 535 aa, Artificial Sequence; identical to SEQ ID NO: 71
  Description of Artificial Sequence: Synthetic polypeptide

SEQ ID NO: 73 - protein, 551 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTHHHHHH

SEQ ID NO: 74 - protein, 551 aa, Artificial Sequence; identical to SEQ ID NO: 73
  Description of Artificial Sequence: Synthetic polypeptide

SEQ ID NO: 75 - protein, 551 aa, Artificial Sequence; identical to SEQ ID NO: 73
  Description of Artificial Sequence: Synthetic polypeptide

SEQ ID NO: 76 - protein, 551 aa, Artificial Sequence; identical to SEQ ID NO: 73
  Description of Artificial Sequence: Synthetic polypeptide

SEQ ID NO: 77 - protein, 551 aa, Artificial Sequence; identical to SEQ ID NO: 73
  Description of Artificial Sequence: Synthetic polypeptide

SEQ ID NO: 78 - protein, 505 aa, Artificial Sequence
  Description of Artificial Sequence: Synthetic polypeptide
MDFQVQIFSFLLISASVIMSRMAQVKLQESGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGQGTTVTVSSGGGGSGGGGSGGGGSDIELTQSPTILSASPGEKVTMTCRASSSVNYMDWYQKKPGSSPKPWIYATSNLASGVPARFSGSGSGTSYSLTISRVEAEDAATYYCQQWSFNPPTFGGGTKLEIKRAAAGDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 79 - protein, 276 aa, Artificial Sequence
  Description of Artificial Sequence: Synthetic polypeptide
MDFQVQIFSFLLISASVIMSRMAQVKLQESGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGQGTTVTVSSGGGGSGGGGSGGGGSDIELTQSPTILSASPGEKVTMTCRASSSVNYMDWYQKKPGSSPKPWIYATSNLASGVPARFSGSGSGTSYSLTISRVEAEDAATYYCQQWSFNPPTFGGGTKLEIKRAAAHHHHHH

SEQ ID NO: 80 - protein, 505 aa, Artificial Sequence
  Description of Artificial Sequence: Synthetic polypeptide
MDFQVQIFSFLLISASVIMSRDIELTQSPTILSASPGEKVTMTCRASSSVNYMDWYQKKPGSSPKPWIYATSNLASGVPARFSGSGSGTSYSLTISRVEAEDAATYYCQQWSFNPPTFGGGTKLEIKRGGGGSGGGGSGGGGSMAQVKLQESGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGQGTTVTVSSAAAGDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 81 - protein, 276 aa, Artificial Sequence
  Description of Artificial Sequence: Synthetic polypeptide
MDFQVQIFSFLLISASVIMSRDIELTQSPTILSASPGEKVTMTCRASSSVNYMDWYQKKPGSSPKPWIYATSNLASGVPARFSGSGSGTSYSLTISRVEAEDAATYYCQQWSFNPPTFGGGTKLEIKRGGGGSGGGGSGGGGSMAQVKLQESGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGQGTTVTVSSAAAHHHHHH

SEQ ID NO: 82 - protein, 782 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSGGGGSMAQVKLQESGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGQGTTVTVSSGGGGSGGGGSGGGGSDIELTQSPTILSASPGEKVTMTCRASSSVNYMDWYQKKPGSSPKPWIYATSNLASGVPARFSGSGSGTSYSLTISRVEAEDAATYYCQQWSFNPPTFGGGTKLEIKRAAAGDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 83 - protein, 553 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSGGGGSMAQVKLQESGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGQGTTVTVSSGGGGSGGGGSGGGGSDIELTQSPTILSASPGEKVTMTCRASSSVNYMDWYQKKPGSSPKPWIYATSNLASGVPARFSGSGSGTSYSLTISRVEAEDAATYYCQQWSFNPPTFGGGTKLEIKRAAAHHHHHH

SEQ ID NO: 84 - protein, 782 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSGGGGSDIELTQSPTILSASPGEKVTMTCRASSSVNYMDWYQKKPGSSPKPWIYATSNLASGVPARFSGSGSGTSYSLTISRVEAEDAATYYCQQWSFNPPTFGGGTKLEIKRGGGGSGGGGSGGGGSMAQVKLQESGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGQGTTVTVSSAAAGDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 85 - protein, 553 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSGGGGSDIELTQSPTILSASPGEKVTMTCRASSSVNYMDWYQKKPGSSPKPWIYATSNLASGVPARFSGSGSGTSYSLTISRVEAEDAATYYCQQWSFNPPTFGGGTKLEIKRGGGGSGGGGSGGGGSMAQVKLQESGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGQGTTVTVSSAAAHHHHHH

SEQ ID NO: 86 - protein, 557 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSGGGGSQVQLVQSGAEDKKPGESVKISCKASGYTFTNYGMNWVRQAPGQGLKWMGWINTYTGESTYADDFKGRFAFSLDTSASTAYLQLSSLRGEDTAVYFCARFAIKGDYWGQGTTVTVSSASTGGGGSGGGGSGGGGSGGGGSDIVMTQSPLSLEVSPGEPASISCRSTKSLLHSDGITYLYWYLQKPGQSPQLLIYQLSNLASGVPDRFSSSGSGTDFTLKISRVEAEDEGTYYCAQNLEIPRTFGQGTKLEIKRTHHHHHH

SEQ ID NO: 87 - protein, 552 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSGGGGSQVQLVQSGAEDVKPDASVKLSCKASGYTFTDYYMHWVRQAPGQGLEWMGRVNPNRRGTTYNQKFEGRVTMTTDTSTSTAYMQLSSLRGEDTAVYYCARANWLDYWGQGTTVTVSSASTGGGGSGGGGSGGGGSGGGGSDIQMTQSPSSLEASVGDRVTITCSVSSSVSSIYLHWYQQKPGKSPKLLIYSTSNLASGVPDRFSGSGSGTDFTLTISSLQAEDEGTYYCQVYSGYPLTFGGGTKLEIKRTHHHHHH

SEQ ID NO: 88 - protein, 555 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSGGGGSQVQLQESGPGDVKPSETLSLTCTVSGGSVSSGDYYWTWIRQSPGKGLEWIGHIYYSGNTNYNPSLKSRLTISIDTSKTTFSLQLSSVTGEDTAIYYCVRDRVTGAFDIWGQGTTVTVSSASTGGGGSGGGGSGGGGSGGGGSDIQMTQSPSSLEASVGDRVTITCQASQDISNYLNWYQQKPGKSPKLLIYDASNLETGVPDRFSGSGSGTDFTFTISSLQAEDEGTYFCQHFDHLPLAFGGGTKLEIKRTHHHHHH

SEQ ID NO: 89 - protein, 287 aa, Artificial Sequence
  Description of Artificial Sequence: Synthetic polypeptide
METDTLLLWVLLLWVPGSTGDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGGSGGGGSGGGGSHHHHHH

SEQ ID NO: 90 - protein, 286 aa, Artificial Sequence
  Description of Artificial Sequence: Synthetic polypeptide
MEFGLSWVFLVALFRGVQCQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGSTSGSGKPGSGEGSTKGDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGGGGSGGGGSGGGGSHHHHHH

SEQ ID NO: 91 - protein, 565 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSGGGGSDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGGSGGGGSGGGGSHHHHHH

SEQ ID NO: 92 - protein, 565 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGSTSGSGKPGSGEGSTKGDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGGGGSGGGGSGGGGSHHHHHH

SEQ ID NO: 93 - protein, 771 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRT

SEQ ID NO: 94 - protein, 827 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGGGGSGGGGSGGGGSGGGGSQVQLQESGPGDVKPSETLSLTCTVSGGSVSSGDYYWTWIRQSPGKGLEWIGHIYYSGNTNYNPSLKSRLTISIDTSKTTFSLQLSSVTGEDTAIYYCVRDRVTGAFDIWGQGTTVTVSSASTGGGGSGGGGSGGGGSGGGGSDIQMTQSPSSLEASVGDRVTITCQASQDISNYLNWYQQKPGKSPKLLIYDASNLETGVPDRFSGSGSGTDFTFTISSLQAEDEGTYFCQHFDHLPLAFGGGTKLEIKRTGGGGSHHHHHH

SEQ ID NO: 95 - protein, 827 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGGGGSGGGGSGGGGSGGGGSDIQMTQSPSSLEASVGDRVTITCQASQDISNYLNWYQQKPGKSPKLLIYDASNLETGVPDRFSGSGSGTDFTFTISSLQAEDEGTYFCQHFDHLPLAFGGGTKLEIKRTGGGGSGGGGSGGGGSGGGGSQVQLQESGPGDVKPSETLSLTCTVSGGSVSSGDYYWTWIRQSPGKGLEWIGHIYYSGNTNYNPSLKSRLTISIDTSKTTFSLQLSSVTGEDTAIYYCVRDRVTGAFDIWGQGTTVTVSSASTGGGGSHHHHHH

SEQ ID NO: 96 - protein, 548 aa, Artificial Sequence
  Description of Artificial Sequence: Synthetic polypeptide
MEFGLSWVFLVALFRGVQCEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGGGGSGGGGSGGGGSGGGGSQVQLQESGPGDVKPSETLSLTCTVSGGSVSSGDYYWTWIRQSPGKGLEWIGHIYYSGNTNYNPSLKSRLTISIDTSKTTFSLQLSSVTGEDTAIYYCVRDRVTGAFDIWGQGTTVTVSSASTGGGGSGGGGSGGGGSGGGGSDIQMTQSPSSLEASVGDRVTITCQASQDISNYLNWYQQKPGKSPKLLIYDASNLETGVPDRFSGSGSGTDFTFTISSLQAEDEGTYFCQHFDHLPLAFGGGTKLEIKRTGGGGSHHHHHH

SEQ ID NO: 97 - protein, 548 aa, Artificial Sequence
  Description of Artificial Sequence: Synthetic polypeptide
MEFGLSWVFLVALFRGVQCEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGGGGSGGGGSGGGGSGGGGSDIQMTQSPSSLEASVGDRVTITCQASQDISNYLNWYQQKPGKSPKLLIYDASNLETGVPDRFSGSGSGTDFTFTISSLQAEDEGTYFCQHFDHLPLAFGGGTKLEIKRTGGGGSGGGGSGGGGSGGGGSQVQLQESGPGDVKPSETLSLTCTVSGGSVSSGDYYWTWIRQSPGKGLEWIGHIYYSGNTNYNPSLKSRLTISIDTSKTTFSLQLSSVTGEDTAIYYCVRDRVTGAFDIWGQGTTVTVSSASTGGGGSHHHHHH

SEQ ID NO: 98 - protein, 551 aa, Artificial Sequence; identical to SEQ ID NO: 73
  Description of Artificial Sequence: Synthetic polypeptide

SEQ ID NO: 99 - protein, 505 aa, Artificial Sequence; identical to SEQ ID NO: 78
  Description of Artificial Sequence: Synthetic polypeptide

SEQ ID NO: 100 - protein, 276 aa, Artificial Sequence; identical to SEQ ID NO: 79
  Description of Artificial Sequence: Synthetic polypeptide

SEQ ID NO: 101 - protein, 505 aa, Artificial Sequence; identical to SEQ ID NO: 80
  Description of Artificial Sequence: Synthetic polypeptide

SEQ ID NO: 102 - protein, 276 aa, Artificial Sequence; identical to SEQ ID NO: 81
  Description of Artificial Sequence: Synthetic polypeptide

SEQ ID NO: 103 - protein, 492 aa, Artificial Sequence
  Description of Artificial Sequence: Synthetic polypeptide
MEFGLSWVFLVALFRGVQCEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 104 - protein, 797 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSGGGGSGGGGSGGGGSGGGGSMAQVKLQESGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGQGTTVTVSSGGGGSGGGGSGGGGSDIELTQSPTILSASPGEKVTMTCRASSSVNYMDWYQKKPGSSPKPWIYATSNLASGVPARFSGSGSGTSYSLTISRVEAEDAATYYCQQWSFNPPTFGGGTKLEIKRAAAGDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 105 - protein, 568 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSGGGGSGGGGSGGGGSGGGGSMAQVKLQESGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGQGTTVTVSSGGGGSGGGGSGGGGSDIELTQSPTILSASPGEKVTMTCRASSSVNYMDWYQKKPGSSPKPWIYATSNLASGVPARFSGSGSGTSYSLTISRVEAEDAATYYCQQWSFNPPTFGGGTKLEIKRAAAHHHHHH

SEQ ID NO: 106 - protein, 779 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSMAQVKLQESGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGQGTTVTVSSGGGGSGGGGSGGGGSDIELTQSPTILSASPGEKVTMTCRASSSVNYMDWYQKKPGSSPKPWIYATSNLASGVPARFSGSGSGTSYSLTISRVEAEDAATYYCQQWSFNPPTFGGGTKLEIKRA

SEQ ID NO: 107 - protein, 783 aa, Artificial Sequence
  Description of Artificial Sequence: Synthetic polypeptide
MDFQVQIFSFLLISASVIMSRMAQVKLQESGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGQGTTVTVSSGGGGSGGGGSGGGGSDIELTQSPTILSASPGEKVTMTCRASSSVNYMDWYQKKPGSSPKPWIYATSNLASGVPARFSGSGSGTSYSLTISRVEAEDAATYYCQQWSFNPPTFGGGTKLEIKRAAAGGGGSGGGGSGGGGSGGGGSPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 108 - protein, 1106 aa, Artificial Sequence
  Description of Artificial Sequence: Synthetic polypeptide
MLRLLLALNLFPSIQVTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDYKDDDDKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPREGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTSRHHHHHH

SEQ ID NO: 109 - protein, 1106 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTSRHHHHHHEGRGSLLTCGDVEENPGPMLRLLLALNLFPSIQVTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDYKDDDDKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 110 - protein, 551 aa, Artificial Sequence; identical to SEQ ID NO: 73
  Description of Artificial Sequence: Synthetic polypeptide

SEQ ID NO: 111 - protein, 551 aa, Artificial Sequence; identical to SEQ ID NO: 73
  Description of Artificial Sequence: Synthetic polypeptide

SEQ ID NO: 112 - protein, 291 aa, Artificial Sequence
  Description of Artificial Sequence: Synthetic polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWK

SEQ ID NO: 113-200 - skipped (88 entries)

SEQ ID NO: 201 - DNA, 1389 bp, Artificial Sequence
  Description of Artificial Sequence: Synthetic polynucleotide
atggagtttgggctgagctgggttttcctcgttgctctttttagaggtgtccagtgtcaggtgcagctgcaggagtcgggcccaggactggtgaagccttcggagaccctgtccctcacctgcactgtctctggtggctccgtcagcagtggtgattactactggacctggatccggcagtccccagggaagggactggagtggattggacacatctattacagtgggaacaccaattataacccctccctcaagagtcgactcaccatatcaattgacacgtccaagactcagttctccctgaagctgagttctgtgaccgctgcggacacggccatttattactgtgtgcgagatcgagtgactggtgcttttgatatctggggccaagggacaatggtcaccgtctcttcagcctccaccaagggcccatcggtcttccccctggcgccctgctccaggagcacctccgagagcacagcggccctgggctgcctggtcaaggactacttccctgaaccggtgacggtgtcgtggaactcaggcgctctgaccagcggcgtgcacaccttcccggctgtcctacagtcctcaggactctactccctcagcagcgtggtgaccgtgccctccagcaacttcggcacccagacctacacctgcaacgtagatcacaagcccagcaataccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttccaaagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggt

SEQ ID NO: 202 - DNA, 1041 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcgggggaggtgggtctggaggtggaggatctggtggaggtgggtctgacatccagatgacccagtctccatcctccctgtctgcatctgtaggagacagagtcaccatcacttgccaggcgagtcaggacatcagcaactatttaaattggtatcagcagaaaccagggaaagcccctaaactcctgatctacgatgcatccaatttggaaacaggggtcccatcaaggttcagtggaagtggatctgggacagattttactttcaccatcagcagcctgcagcctgaagatattgcaacatatttctgtcaacactttgatcatctcccgctcgctttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 203 - DNA, 1731 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcgggggaggtgggtctggaggtggaggatctggtggaggtgggtctcaggtgcagctgcaggagtcgggcccaggactggtgaagccttcggagaccctgtccctcacctgcactgtctctggtggctccgtcagcagtggtgattactactggacctggatccggcagtccccagggaagggactggagtggattggacacatctattacagtgggaacaccaattataacccctccctcaagagtcgactcaccatatcaattgacacgtccaagactcagttctccctgaagctgagttctgtgaccgctgcggacacggccatttattactgtgtgcgagatcgagtgactggtgcttttgatatctggggccaagggacaatggtcaccgtctcttcagcctccaccaagggcccatcggtcttccccctggcgccctgctccaggagcacctccgagagcacagcggccctgggctgcctggtcaaggactacttccctgaaccggtgacggtgtcgtggaactcaggcgctctgaccagcggcgtgcacaccttcccggctgtcctacagtcctcaggactctactccctcagcagcgtggtgaccgtgccctccagcaacttcggcacccagacctacacctgcaacgtagatcacaagcccagcaataccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttccaaagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggt

SEQ ID NO: 204 - DNA, 702 bp, Artificial Sequence
  Description of Artificial Sequence: Synthetic polynucleotide
atggagacagacacactcctgctatgggtactgctgctctgggttccaggttccactggtgacatccagatgacccagtctccatcctccctgtctgcatctgtaggagacagagtcaccatcacttgccaggcgagtcaggacatcagcaactatttaaattggtatcagcagaaaccagggaaagcccctaaactcctgatctacgatgcatccaatttggaaacaggggtcccatcaaggttcagtggaagtggatctgggacagattttactttcaccatcagcagcctgcagcctgaagatattgcaacatatttctgtcaacactttgatcatctcccgctcgctttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 205 - DNA, 1068 bp, Artificial Sequence
  Description of Artificial Sequence: Synthetic polynucleotide
atggagacagacacactcctgctatgggtactgctgctctgggttccaggttccactggtgacatccagatgacccagtctccatcctccctgtctgcatctgtaggagacagagtcaccatcacttgccaggcgagtcaggacatcagcaactatttaaattggtatcagcagaaaccagggaaagcccctaaactcctgatctacgatgcatccaatttggaaacaggggtcccatcaaggttcagtggaagtggatctgggacagattttactttcaccatcagcagcctgcagcctgaagatattgcaacatatttctgtcaacactttgatcatctcccgctcgctttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgtgacaaaactcacacatcgccaccgtccccagcacctgaagccgcggggggaccgtcagaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggg

SEQ ID NO: 206 - DNA, 1743 bp, Artificial Sequence
  Description of Artificial Sequence: Synthetic polynucleotide
atggagtttgggctgagctgggttttcctcgttgctctttttagaggtgtccagtgtcaggtgcagctgcaggagtcgggcccaggactggtgaagccttcggagaccctgtccctcacctgcactgtctctggtggctccgtcagcagtggtgattactactggacctggatccggcagtccccagggaagggactggagtggattggacacatctattacagtgggaacaccaattataacccctccctcaagagtcgactcaccatatcaattgacacgtccaagactcagttctccctgaagctgagttctgtgaccgctgcggacacggccatttattactgtgtgcgagatcgagtgactggtgcttttgatatctggggccaagggacaatggtcaccgtctcttcagcctccaccaagggcccatcggtcttccccctggcgccctgctccaggagcacctccgagagcacagcggccctgggctgcctggtcaaggactacttccctgaaccggtgacggtgtcgtggaactcaggcgctctgaccagcggcgtgcacaccttcccggctgtcctacagtcctcaggactctactccctcagcagcgtggtgaccgtgccctccagcaacttcggcacccagacctacacctgcaacgtagatcacaagcccagcaataccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttccaaagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggtggaggtgggtctggaggtggaggatctggtggaggtgggtctgaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggg

SEQ ID NO: 207 - DNA, 1380 bp, Artificial Sequence
  Description of Artificial Sequence: Synthetic polynucleotide
atggagtttgggctgagctgggttttcctcgttgctctttttagaggtgtccagtgtcaggttcagctggtgcagtctggtgctgaggtgaagaagcctggtgcctcagtgaaggtctcctgcaaggcttctggttacacattcactgactactacatgcactgggtgcgtcaggcccctggtcaaggtcttgagtggatgggtcgtgttaatcctaaccggaggggtactacctacaaccagaaattcgagggccgtgtcaccatgaccacagacacatccacgagcacagcctacatggagctgcgtagcctgcgttctgacgacacggccgtgtattactgtgcgcgtgcgaactggcttgactactggggccagggcaccaccgtcaccgtctcctccgcctccaccaagggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggt

SEQ ID NO: 208 - DNA, 1049 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcgggggaggtgggtctggaggtggaggatctggtggaggtgggtctgacatccagatgacccagtctccatcctccctgtctgcatctgtaggagacagagtcaccatcacttgcagtgtcagctcaagtgtatcctccatttacttgcactggtatcagcagaaaccagggaaagcccctaagctcctgatctatagcacatccaacttggcttctggagtcccatcaaggttcagtggcagtggatctgggacagatttcactctcaccatcagcagtctgcaacctgaagattttgcaacttactactgtcaagtctacagtggttacccgctcacgttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgctaata

SEQ ID NO: 209 - DNA, 1719 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcgggggaggtgggtctggaggtggaggatctggtggaggtgggtctcaggttcagctggtgcagtctggtgctgaggtgaagaagcctggtgcctcagtgaaggtctcctgcaaggcttctggttacacattcactgactactacatgcactgggtgcgtcaggcccctggtcaaggtcttgagtggatgggtcgtgttaatcctaaccggaggggtactacctacaaccagaaattcgagggccgtgtcaccatgaccacagacacatccacgagcacagcctacatggagctgcgtagcctgcgttctgacgacacggccgtgtattactgtgcgcgtgcgaactggcttgactactggggccagggcaccaccgtcaccgtctcctccgcctccaccaagggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctg

SEQ ID NO: 210 - DNA, 705 bp, Artificial Sequence
  Description of Artificial Sequence: Synthetic polynucleotide
atggagacagacacactcctgctatgggtactgctgctctgggttccaggttccactggtgacatccagatgacccagtctccatcctccctgtctgcatctgtaggagacagagtcaccatcacttgcagtgtcagctcaagtgtatcctccatttacttgcactggtatcagcagaaaccagggaaagcccctaagctcctgatctatagcacatccaacttggcttctggagtcccatcaaggttcagtggcagtggatctgggacagatttcactctcaccatcagcagtctgcaacctgaagattttgcaacttactactgtcaagtctacagtggttacccgctcacgttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 211 - DNA, 1071 bp, Artificial Sequence
  Description of Artificial Sequence: Synthetic polynucleotide
atggagacagacacactcctgctatgggtactgctgctctgggttccaggttccactggtgacatccagatgacccagtctccatcctccctgtctgcatctgtaggagacagagtcaccatcacttgcagtgtcagctcaagtgtatcctccatttacttgcactggtatcagcagaaaccagggaaagcccctaagctcctgatctatagcacatccaacttggcttctggagtcccatcaaggttcagtggcagtggatctgggacagatttcactctcaccatcagcagtctgcaacctgaagattttgcaacttactactgtcaagtctacagtggttacccgctcacgttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgcgacaaaactcacacatcgccaccgtccccagcacctgaagccgcggggggaccgtcagaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggg

SEQ ID NO: 212 - DNA, 1734 bp, Artificial Sequence
  Description of Artificial Sequence: Synthetic polynucleotide
atggagtttgggctgagctgggttttcctcgttgctctttttagaggtgtccagtgtcaggttcagctggtgcagtctggtgctgaggtgaagaagcctggtgcctcagtgaaggtctcctgcaaggcttctggttacacattcactgactactacatgcactgggtgcgtcaggcccctggtcaaggtcttgagtggatgggtcgtgttaatcctaaccggaggggtactacctacaaccagaaattcgagggccgtgtcaccatgaccacagacacatccacgagcacagcctacatggagctgcgtagcctgcgttctgacgacacggccgtgtattactgtgcgcgtgcgaactggcttgactactggggccagggcaccaccgtcaccgtctcctccgcctccaccaagggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtggtggaggtgggtctggaggtggaggatctggtggaggtgggtctgaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggg

SEQ ID NO: 213 - DNA, 1938 bp, Artificial Sequence
  Description of Artificial Sequence: Synthetic polynucleotide
atggagacagacacactcctgctatgggtactgctgctctgggttccaggttccactggtgacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggactaagttggaaataacaggaggaggtgggtctggaggtggaggatctggtggaggtgggtctggaggaggtgggtctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcaccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacacccagcggttctcgggcaagaggttgggggacaccttcgtcctcaccctgagcgacttccgccgagagaacgagggctactatttctgctcggccctgagcaactccatcatgtacttcagccacttcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 214 - DNA, 375 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcgggcatcatcaccatcaccat

SEQ ID NO: 215 - DNA, 1035 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggt

SEQ ID NO: 216 - DNA, 822 bp, Artificial Sequence
  Description of Artificial Sequence: Synthetic polynucleotide
atggagtttgggctgagctgggttttcctcgttgctctttttagaggtgtccagtgtgaggtgcagctggtggagtctggtggtggtcttgttcaacctggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacctggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacggggccccatcatcaccatcaccat

SEQ ID NO: 217 - DNA, 840 bp, Artificial Sequence
  Description of Artificial Sequence: Synthetic polynucleotide
atggagtttgggctgagctgggttttcctcgttgctctttttagaggtgtccagtgtcaggtgcagctggtgcagagcggcgccgaggacaagaagcccggcgagagcgtgaagatcagctgcaaggccagcggctacaccttcaccaactacggcatgaactgggtgaggcaggcccccggccagggcctgaagtggatgggctggatcaacacctacaccggcgagagcacctacgccgacgacttcaagggcaggttcgccttcagcctggacaccagcgccagcaccgcctacctgcagctgagcagcctgaggggcgaggacaccgccgtgtacttctgcgccaggttcgccatcaagggcgactactggggccagggcaccaccgtgaccgtgagcagcgccagcaccggcggcggcggcagcggcggcggcggcagcggcggcggcggcagcggcggcggcggcagcgacatcgtgatgacccagagccccctgagcctggaggtgagccccggcgagcccgccagcatcagctgcaggagcaccaagagcctgctgcacagcgacggcatcacctacctgtactggtacctgcagaagcccggccagagcccccagctgctgatctaccagctgagcaacctggccagcggcgtgcccgacaggttcagcagcagcggcagcggcaccgacttcaccctgaagatcagcagggtggaggccgaggacgagggcacctactactgcgcccagaacctggagatccccaggaccttcggccagggcaccaagctggagatcaagaggaccgggccccatcatcaccatcaccat

SEQ ID NO: 218 - DNA, 834 bp, Artificial Sequence
  Description of Artificial Sequence: Synthetic polynucleotide
atggagacagacacactcctgctatgggtactgctgctctgggttccaggttccactggtgacatcgtgatgacccagagccccctgagcctgcccgtgacccccggcgagcccgccagcatcagctgcaggagcaccaagagcctgctgcacagcgacggcatcacctacctgtactggtacctgcagaagcccggccagagcccccagctgctgatctaccagctgagcaacctggccagcggcgtgcccgacaggttcagcagcagcggcagcggcaccgacttcaccctgaagatcagcagggtggaggccgaggacgagggcgtgtactactgcgcccagaacctggagatccccaggaccttcggctgcggcaccaagctggagatcaagaggaccggcggcggcggcagcggcggcggcggcagcggcggcggcggcagcggcggcggcggcagccaggtgcagctggtgcagagcggcgccgaggtgaagaagcccggcgagagcgtgaagatcagctgcaaggccagcggctacaccttcaccaactacggcatgaactgggtgaggcaggcccccggccagtgcctgaagtggatgggctggatcaacacctacaccggcgagagcacctacgccgacgacttcaagggcaggttcgccttcagcctggacaccagcgccagcaccgcctacctgcagctgagcagcctgaggagcgaggacaccgccgtgtacttctgcgccaggttcgccatcaagggcgactactggggccagggcaccctggtgaccgtgagcagcgggccccatcatcaccatcaccat

SEQ ID NO: 219 - DNA, 825 bp, Artificial Sequence
  Description of Artificial Sequence: Synthetic polynucleotide
atggagtttgggctgagctgggttttcctcgttgctctttttagaggtgtccagtgtcaggttcagctggtgcagtctggtgctgaggatgtgaagcctgatgcctcagtgaagctctcctgcaaggcttctggttacacattcactgactactacatgcactgggtgcgtcaggcccctggtcaaggtcttgagtggatgggtcgtgttaatcctaaccggaggggtactacctacaaccagaaattcgagggccgtgtcaccatgaccacagacacatccacgagcacagcctacatgcagctgagtagcctgcgtggtgaagacacggccgtgtattactgtgcgcgtgcgaactggcttgactactggggccagggcaccaccgtcaccgtctcctccgcctccaccgggggaggtgggtctggaggtggaggatctggtggaggtgggtctggtggaggtgggtctgacatccagatgacccagtctccatcctccctggaggcatctgtaggagacagagtcaccatcacttgcagtgtcagctcaagtgtatcctccatttacttgcactggtatcagcagaaaccagggaaaagccctaagctcctgatctatagcacatccaacttggcttctggagtcccagataggttcagtggcagtggatctgggacagatttcactctcaccatcagcagtctgcaagccgaagatgagggcacttactactgtcaagtctacagtggttacccgctcacgttcggcggagggaccaagctggagatcaaacgaactgggccccatcatcaccatcaccat

SEQ ID NO: 220 - DNA, 819 bp, Artificial Sequence
  Description of Artificial Sequence: Synthetic polynucleotide
atggagacagacacactcctgctatgggtactgctgctctgggttccaggttccactggtgacatccagatgacccagtctccatcctccctgtctgcatctgtaggagacagagtcaccatcacttgcagtgtcagctcaagtgtatcctccatttacttgcactggtatcagcagaaaccagggaaagcccctaagctcctgatctatagcacatccaacttggcttctggagtcccatcaaggttcagtggcagtggatctgggacagatttcactctcaccatcagcagtctgcaacctgaagatgaagcaacttactactgtcaagtctacagtggttacccgctcacgttcggctgcgggaccaaggtggagatcaaacgaactgggggaggtgggtctggaggtggaggatctggtggaggtgggtctggtggaggtgggtctcaggttcagctggtgcagtctggtgctgaggataagaagcctggtgcctcagtgaaggtctcctgcaaggcttctggttacacattcactgactactacatgcactgggtgcgtcaggcccctggtcaatgtcttgagtggatgggtcgtgttaatcctaaccggaggggtactacctacaaccagaaattcgagggccgtgtcaccatgaccacagacacatccacgagcacagcctacatggagctgcgtagcctgcgttctgacgacacggccgtgtattactgtgcgcgtgcgaactggcttgactactggggccagggcaccaccgtcaccgtctcctccgggccccatcatcaccatcaccat

SEQ ID NO: 221 - DNA, 834 bp, Artificial Sequence
  Description of Artificial Sequence: Synthetic polynucleotide
atggagtttgggctgagctgggttttcctcgttgctctttttagaggtgtccagtgtcaggtgcagctgcaggagagcggccccggcgacgtgaagcccagcgagaccctgagcctgacctgcaccgtgagcggcggcagcgtgagcagcggcgactactactggacctggatcaggcagagccccggcaagggcctggagtggatcggccacatctactacagcggcaacaccaactacaaccccagcctgaagagcaggctgaccatcagcatcgacaccagcaagaccaccttcagcctgcagctgagcagcgtgaccggcgaggacaccgccatctactactgcgtgagggacagggtgaccggcgccttcgacatctggggccagggcaccaccgtgaccgtgagcagcgccagcaccggcggcggcggcagcggcggcggcggcagcggcggcggcggcagcggcggcggcggcagcgacatccagatgacccagagccccagcagcctggaggccagcgtgggcgacagggtgaccatcacctgccaggccagccaggacatcagcaactacctgaactggtaccagcagaagcccggcaagagccccaagctgctgatctacgacgccagcaacctggagaccggcgtgcccgacaggttcagcggcagcggcagcggcaccgacttcaccttcaccatcagcagcctgcaggccgaggacgagggcacctacttctgccagcacttcgaccacctgcccctggccttcggcggcggcaccaagctggagatcaagaggaccgggccccatcatcaccatcaccat

SEQ ID NO: 222 - DNA, 828 bp, Artificial Sequence
  Description of Artificial Sequence: Synthetic polynucleotide
atggagacagacacactcctgctatgggtactgctgctctgggttccaggttccactggtgacatccagatgacccagagccccagcagcctgagcgccagcgtgggcgacagggtgaccatcacctgccaggccagccaggacatcagcaactacctgaactggtaccagcagaagcccggcaaggcccccaagctgctgatctacgacgccagcaacctggagaccggcgtgcccagcaggttcagcggcagcggcagcggcaccgacttcaccttcaccatcagcagcctgcagcccgaggacgaggccacctacttctgccagcacttcgaccacctgcccctggccttcggctgcggcaccaaggtggagatcaagaggaccggcggcggcggcagcggcggcggcggcagcggcggcggcggcagcggcggcggcggcagccaggtgcagctgcaggagagcggccccggcgacgtgaagcccagcgagaccctgagcctgacctgcaccgtgagcggcggcagcgtgagcagcggcgactactactggacctggatcaggcagagccccggcaagtgcctggagtggatcggccacatctactacagcggcaacaccaactacaaccccagcctgaagagcaggctgaccatcagcatcgacaccagcaagacccagttcagcctgaagctgagcagcgtgaccgccgccgacaccgccatctactactgcgtgagggacagggtgaccggcgccttcgacatctggggccagggcaccaccgtgaccgtgagcagcgggccccatcatcaccatcaccat

SEQ ID NO: 223 - DNA, 1368 bp, Artificial Sequence
  Description of Artificial Sequence: Synthetic polynucleotide
atgccacctcctcgcctcctcttcttcctcctcttcctcacccccatggaagtcaggcatcatcaccatcaccatcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagggggaggtgggtctggaggtggaggatctggtggaggtgggtctgtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctg

SEQ ID NO: 224 - DNA, 1194 bp, Artificial Sequence
  Description of Artificial Sequence: Synthetic polynucleotide
atggagtttgggctgagctgggttttcctcgttgctctttttagaggtgtccagtgtgaggtgcagctggtggagtctggtggtggtcttgttcaacctggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacctggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacggacaaaactcacacatcgccaccgtccccagcacctgaagccgcggggggaccgtcagaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcgggtctagagggccccatcatcaccatcaccat

SEQ ID NO: 225 - DNA, 1842 bp, Artificial Sequence
  Description of Artificial Sequence: Synthetic polynucleotide
atggagtttgggctgagctgggttttcctcgttgctctttttagaggtgtccagtgtgaggtgcagctggtggagtctggtggtggtcttgttcaacctggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacctggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacggacaaaactcacacatcgccaccgtccccagcacctgaagccgcggggggaccgtcagaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggt

SEQ ID NO: 226 - DNA, 1188 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggggggaggtgggtctggaggtggaggatctggtggaggtgggtctggtggaggtgggtctgaggtgcagctggtggagtctggtggtggtcttgttcaacctggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacctggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacgtctagagggccccatcatcaccatcaccat

SEQ ID NO: 227 - DNA, 1836 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggggggaggtgggtctggaggtggaggatctggtggaggtgggtctggtggaggtgggtctgaggtgcagctggtggagtctggtggtggtcttgttcaacctggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacctggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacggacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggt

SEQ ID NO: 228 - DNA, 852 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccacatcatcaccatcaccat

SEQ ID NO: 229 - DNA, 1512 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggt

SEQ ID NO: 230 - DNA, 384 bp, Artificial Sequence
  Description of Artificial Sequence: Synthetic polynucleotide
atgccacctcctcgcctcctcttcttcctcctcttcctcacccccatggaagtcaggccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccacatcatcaccatcaccat

SEQ ID NO: 231 - DNA, 1044 bp, Artificial Sequence
  Description of Artificial Sequence: Synthetic polynucleotide
atgccacctcctcgcctcctcttcttcctcctcttcctcacccccatggaagtcaggccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggt

SEQ ID NO: 232 - DNA, 1521 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccaggaggaggtgggtctggaggtggaggatctggtggaggtgggtctgacatccagatgacccagtctccatcctccctgtctgcatctgtaggagacagagtcaccatcacttgccaggcgagtcaggacatcagcaactatttaaattggtatcagcagaaaccagggaaagcccctaaactcctgatctacgatgcatccaatttggaaacaggggtcccatcaaggttcagtggaagtggatctgggacagattttactttcaccatcagcagcctgcagcctgaagatattgcaacatatttctgtcaacactttgatcatctcccgctcgctttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 233 - DNA, 2211 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccaggaggaggtgggtctggaggtggaggatctggtggaggtgggtctcaggtgcagctgcaggagtcgggcccaggactggtgaagccttcggagaccctgtccctcacctgcactgtctctggtggctccgtcagcagtggtgattactactggacctggatccggcagtccccagggaagggactggagtggattggacacatctattacagtgggaacaccaattataacccctccctcaagagtcgactcaccatatcaattgacacgtccaagactcagttctccctgaagctgagttctgtgaccgctgcggacacggccatttattactgtgtgcgagatcgagtgactggtgcttttgatatctggggccaagggacaatggtcaccgtctcttcagcctccaccaagggcccatcggtcttccccctggcgccctgctccaggagcacctccgagagcacagcggccctgggctgcctggtcaaggactacttccctgaaccggtgacggtgtcgtggaactcaggcgctctgaccagcggcgtgcacaccttcccggctgtcctacagtcctcaggactctactccctcagcagcgtggtgaccgtgccctccagcaacttcggcacccagacctacacctgcaacgtagatcacaagcccagcaataccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttccaaagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggt

SEQ ID NO: 234 - DNA, 1536 bp, Artificial Sequence
  Description of Artificial Sequence: Synthetic polynucleotide
atggagacagacacactcctgctatgggtactgctgctctgggttccaggttccactggtgacatccagatgacccagtctccatcctccctgtctgcatctgtaggagacagagtcaccatcacttgccaggcgagtcaggacatcagcaactatttaaattggtatcagcagaaaccagggaaagcccctaaactcctgatctacgatgcatccaatttggaaacaggggtcccatcaaggttcagtggaagtggatctgggacagattttactttcaccatcagcagcctgcagcctgaagatattgcaacatatttctgtcaacactttgatcatctcccgctcgctttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgtgacaaaactcacacatcgccaccgtccccagcacctgaagccgcggggggaccgtcacccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggcca

SEQ ID NO: 235 - DNA, 2211 bp, Artificial Sequence
  Description of Artificial Sequence: Synthetic polynucleotide
atggagtttgggctgagctgggttttcctcgttgctctttttagaggtgtccagtgtcaggtgcagctgcaggagtcgggcccaggactggtgaagccttcggagaccctgtccctcacctgcactgtctctggtggctccgtcagcagtggtgattactactggacctggatccggcagtccccagggaagggactggagtggattggacacatctattacagtgggaacaccaattataacccctccctcaagagtcgactcaccatatcaattgacacgtccaagactcagttctccctgaagctgagttctgtgaccgctgcggacacggccatttattactgtgtgcgagatcgagtgactggtgcttttgatatctggggccaagggacaatggtcaccgtctcttcagcctccaccaagggcccatcggtcttccccctggcgccctgctccaggagcacctccgagagcacagcggccctgggctgcctggtcaaggactacttccctgaaccggtgacggtgtcgtggaactcaggcgctctgaccagcggcgtgcacaccttcccggctgtcctacagtcctcaggactctactccctcagcagcgtggtgaccgtgccctccagcaacttcggcacccagacctacacctgcaacgtagatcacaagcccagcaataccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttccaaagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggtggaggtgggtctggaggtggaggatctggtggaggtgggtctcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggcca

SEQ ID NO: 236 - DNA, 1525 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccaggaggaggtgggtctggaggtggaggatctggtggaggtgggtctgacatccagatgacccagtctccatcctccctgtctgcatctgtaggagacagagtcaccatcacttgcagtgtcagctcaagtgtatcctccatttacttgcactggtatcagcagaaaccagggaaagcccctaagctcctgatctatagcacatccaacttggcttctggagtcccatcaaggttcagtggcagtggatctgggacagatttcactctcaccatcagcagtctgcaacctgaagattttgcaacttactactgtcaagtctacagtggttacccgctcacgttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgct

SEQ ID NO: 237 - DNA, 2199 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccaggaggaggtgggtctggaggtggaggatctggtggaggtgggtctcaggttcagctggtgcagtctggtgctgaggtgaagaagcctggtgcctcagtgaaggtctcctgcaaggcttctggttacacattcactgactactacatgcactgggtgcgtcaggcccctggtcaaggtcttgagtggatgggtcgtgttaatcctaaccggaggggtactacctacaaccagaaattcgagggccgtgtcaccatgaccacagacacatccacgagcacagcctacatggagctgcgtagcctgcgttctgacgacacggccgtgtattactgtgcgcgtgcgaactggcttgactactggggccagggcaccaccgtcaccgtctcctccgcctccaccaagggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctg

SEQ ID NO: 238 - DNA, 1539 bp, Artificial Sequence
  Description of Artificial Sequence: Synthetic polynucleotide
atggagacagacacactcctgctatgggtactgctgctctgggttccaggttccactggtgacatccagatgacccagtctccatcctccctgtctgcatctgtaggagacagagtcaccatcacttgcagtgtcagctcaagtgtatcctccatttacttgcactggtatcagcagaaaccagggaaagcccctaagctcctgatctatagcacatccaacttggcttctggagtcccatcaaggttcagtggcagtggatctgggacagatttcactctcaccatcagcagtctgcaacctgaagattttgcaacttactactgtcaagtctacagtggttacccgctcacgttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgcgacaaaactcacacatcgccaccgtccccagcacctgaagccgcggggggaccgtcacccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggcca

SEQ ID NO: 239 - DNA, 2202 bp, Artificial Sequence
  Description of Artificial Sequence: Synthetic polynucleotide
atggagtttgggctgagctgggttttcctcgttgctctttttagaggtgtccagtgtcaggttcagctggtgcagtctggtgctgaggtgaagaagcctggtgcctcagtgaaggtctcctgcaaggcttctggttacacattcactgactactacatgcactgggtgcgtcaggcccctggtcaaggtcttgagtggatgggtcgtgttaatcctaaccggaggggtactacctacaaccagaaattcgagggccgtgtcaccatgaccacagacacatccacgagcacagcctacatggagctgcgtagcctgcgttctgacgacacggccgtgtattactgtgcgcgtgcgaactggcttgactactggggccagggcaccaccgtcaccgtctcctccgcctccaccaagggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtggtggaggtgggtctggaggtggaggatctggtggaggtgggtctcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggcca

SEQ ID NO: 240 - DNA, 1662 bp, Artificial Sequence
  Description of Artificial Sequence: Synthetic polynucleotide
atggagtttgggctgagctgggttttcctcgttgctctttttagaggtgtccagtgtgaggtgcagctggtggagtctggtggtggtcttgttcaacctggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacctggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacggacaaaactcacacatcgccaccgtccccagcacctgaagccgcggggggaccgtcacccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccatctagagggccccatcatcaccatcaccat

SEQ ID NO: 241 - DNA, 2310 bp, Artificial Sequence
  Description of Artificial Sequence: Synthetic polynucleotide
atggagtttgggctgagctgggttttcctcgttgctctttttagaggtgtccagtgtgaggtgcagctggtggagtctggtggtggtcttgttcaacctggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacctggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacggacaaaactcacacatcgccaccgtccccagcacctgaagccgcggggggaccgtcacccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggt

SEQ ID NO: 242 - DNA, 1665 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagggggaggtgggtctggaggtggaggatctggtggaggtgggtctggtggaggtgggtctgaggtgcagctggtggagtctggtggtggtcttgttcaacctggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacctggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacgtctagagggccccatcatcaccatcaccat

SEQ ID NO: 243 - DNA, 2313 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagggggaggtgggtctggaggtggaggatctggtggaggtgggtctggtggaggtgggtctgaggtgcagctggtggagtctggtggtggtcttgttcaacctggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacctggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacggacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggt

SEQ ID NO: 244-245 - skipped (2 entries)

SEQ ID NO: 246 - DNA, 1083 bp, Artificial Sequence
  Description of Artificial Sequence: Synthetic polynucleotide
aagcttaatttaaggcaggatgtctcagagtctgggaaaatcccactttcctcctgctacaccttacagttgtgagaaagcacatttcagacaacagggaaaacccatacttcaccacaacaacacactatacattgtctggtccactggagcataaattaaagagaaacaatgtagtcaagcaagtaggcggcaagaggaagggggcggagacatcatcagggagtataaactctgagatgcctcagagcctcacagactcaacaagagctccagcaaagactttcactgtagcttgacttgacctgagattaactagggaatcttgagaataaagaagcttaactagttagcggaccgacgcgtacgcggccgctcgagatggagagcgacgagagcggcctgcccgccatggagatcgagtgccgcatcaccggcaccctgaacggcgtggagttcgagctggtgggcggcggagagggcacccccgagcagggccgcatgaccaacaagatgaagagcaccaaaggcgccctgaccttcagcccctacctgctgagccacgtgatgggctacggcttctaccacttcggcacctaccccagcggctacgagaaccccttcctgcacgccatcaacaacggcggctacaccaacacccgcatcgagaagtacgaggacggcggcgtgctgcacgtgagcttcagctaccgctacgaggccggccgcgtgatcggcgacttcaaggtgatgggcaccggcttccccgaggacagcgtgatcttcaccgacaagatcatccgcagcaacgccaccgtggagcacctgcaccccatgggcgataacgatctggatggcagcttcacccgcaccttcagcctgcgcgacggcggctactacagctccgtggtggacagccacatgcacttcaagagcgccatccaccccagcatcctgcagaacgggggccccatgttcgccttccgccgcgtggaggaggatcacagcaacaccgagctgggcatcgtggagtaccagcacgccttcaagaccccggatgcagatgccggtgaagaaagagtt

SEQ ID NO: 247 - DNA, 1790 bp, Artificial Sequence
  Description of Artificial Sequence: Synthetic polynucleotide
aagctttaacgaagacagggccatgtagagggccccagggagtgaaagggcctccaggacctccaggtatggaatacaggggacgtttaagaagatatggccacacactggggccctgagaagtgagagcttcatgaaaaaaatcagggaccccagagttccttggaagccaagactgaaaccagcattatgagtctccgggtcagaatgaaagaagaaggcctgccccagtggggtctgtgaattcccgggggtgatttcactccccggggctgtcccaggcttgtccctgctacccccacccagcctttcctgaggcctcaagcctgccaccaagcccccagctccttctccccgcagggacccaaacacaggcctcgggactcaacacagcttttccctccaaccccgttttctctccctcaaggactcagctttctgaggcccctcccagttctagttctatctttttcctgcatcctgtctggaagttagaaggaaacagaccacagacctggtccccaaaagaaatggaggcaataggttttgaggggcatggggacggggttcagcctccagggtcctacacacaaatcagtcagtggcccagaagaccccctcggaatcggagcagggaggatggggagtgtgaggggtatccttgatgcttgtgtgtccccaactttccaaatccccgcccccgcgatggagaagaaaccgagacagaaggtgcagggcccactaccgcttcctccagatgagctcatgggtttctccaccaaggaagttttccgctggttgaatgattctttccccgccctcctctcgccccagggacatataaaggcagttgttggcacacccagccagcagacgctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacacaagcttaactagttagcggaccgacgcgtacgcggccgctcgagatggagagcgacgagagcggcctgcccgccatggagatcgagtgccgcatcaccggcaccctgaacggcgtggagttcgagctggtgggcggcggagagggcacccccgagcagggccgcatgaccaacaagatgaagagcaccaaaggcgccctgaccttcagcccctacctgctgagccacgtgatgggctacggcttctaccacttcggcacctaccccagcggctacgagaaccccttcctgcacgccatcaacaacggcggctacaccaacacccgcatcgagaagtacgaggacggcggcgtgctgcacgtgagcttcagctaccgctacgaggccggccgcgtgatcggcgacttcaaggtgatgggcaccggcttccccgaggacagcgtgatcttcaccgacaagatcatccgcagcaacgccaccgtggagcacctgcaccccatgggcgataacgatctggatggcagcttcacccgcaccttcagcctgcgcgacggcggctactacagctccgtggtggacagccacatgcacttcaagagcgccatccaccccagcatcctgcagaacgggggccccatgttcgccttccgccgcgtggaggaggatcacagcaacaccgagctgggcatcgtggagtaccagcacgccttcaagaccccggatgcagatgccggtgaagaaagagtt

SEQ ID NO: 248 - DNA, 1519 bp, Artificial Sequence
  Description of Artificial Sequence: Synthetic polynucleotide
aagcttgggagaagctagacttaaaatcttccattgcagctgtaaacacatctggacaatagtctgttttctgcatttgtgaatcccacacccatggaactatgaatcgtgcatcagagttatttaaaaccaccgtgcatggagtgaaccaataccgaggtgtttgcttatcattttcctttgagcacacagcacagccttgaactcagtgacactcctaagagggctctagggtcaggccaacttagatgagatgctagtctttagctaaagatgcccttccacccccgttgcacgaccttgcttctcagtctttgttgagtcttctgggggagaatccccctagaggactcagtttacaaaaccctaagtgagaccactgccaagaagtgcttgctcacccctcctgccgcggcagggaatccccctttccttgtacaggcaaaacacaaaaaaggactcataagtgaagcctgatccttctcaccaaacactgcccacacctcctagtaattgaacttgaaaaaaaaaactggtttgaaaaattaccgcaaaccatattgtcataaaaaaaaaaaaaaacacttcctatatgagatcacagaacagagtaggcacaagttcctgctgagcagatcagcctaatgcttaaatagaacaactcctggctgtcattgacattgtctaaaagccaagatgacagactgagaggcctgagcccttgttctggcattctcccaggaagatgcagtaaaggggttgacccaatatacaagcttaactagttagcggaccgacgcgtacgcggccgctcgagatggagagcgacgagagcggcctgcccgccatggagatcgagtgccgcatcaccggcaccctgaacggcgtggagttcgagctggtgggcggcggagagggcacccccgagcagggccgcatgaccaacaagatgaagagcaccaaaggcgccctgaccttcagcccctacctgctgagccacgtgatgggctacggcttctaccacttcggcacctaccccagcggctacgagaaccccttcctgcacgccatcaacaacggcggctacaccaacacccgcatcgagaagtacgaggacggcggcgtgctgcacgtgagcttcagctaccgctacgaggccggccgcgtgatcggcgacttcaaggtgatgggcaccggcttccccgaggacagcgtgatcttcaccgacaagatcatccgcagcaacgccaccgtggagcacctgcaccccatgggcgataacgatctggatggcagcttcacccgcaccttcagcctgcgcgacggcggctactacagctccgtggtggacagccacatgcacttcaagagcgccatccaccccagcatcctgcagaacgggggccccatgttcgccttccgccgcgtggaggaggatcacagcaacaccgagctgggcatcgtggagtaccagcacgccttcaagaccccggatgcagatgccggtgaagaaagagtt

SEQ ID NO: 249 - DNA, 1115 bp, Artificial Sequence
  Description of Artificial Sequence: Synthetic polynucleotide
aagcttgatatcgaattaggaggaaaactgtttcatacagaaggcgtcaattaggaggaaaaactgtttcatacagaaggcgtcaattaggaggaaaaactgtttcatacagaaggcgtcaattggtcccatcgaattaggaggaaaaactgtttcatacagaaggcgtcaattaggaggaaaaactgtttcatacagaaggcgtcaattaggaggaaaaactgtttcatacagaaggcgtcaattggtcccgggacattttgacacccccataatatttttccagaattaacagtataaattgcatctcttgttcaagagttccctatcactctctttaatcactactcacagtaacctcaactcctgaagcttaactagttagcggaccgacgcgtacgcggccgctcgagatggagagcgacgagagcggcctgcccgccatggagatcgagtgccgcatcaccggcaccctgaacggcgtggagttcgagctggtgggcggcggagagggcacccccgagcagggccgcatgaccaacaagatgaagagcaccaaaggcgccctgaccttcagcccctacctgctgagccacgtgatgggctacggcttctaccacttcggcacctaccccagcggctacgagaaccccttcctgcacgccatcaacaacggcggctacaccaacacccgcatcgagaagtacgaggacggcggcgtgctgcacgtgagcttcagctaccgctacgaggccggccgcgtgatcggcgacttcaaggtgatgggcaccggcttccccgaggacagcgtgatcttcaccgacaagatcatccgcagcaacgccaccgtggagcacctgcaccccatgggcgataacgatctggatggcagcttcacccgcaccttcagcctgcgcgacggcggctactacagctccgtggtggacagccacatgcacttcaagagcgccatccaccccagcatcctgcagaacgggggccccatgttcgccttccgccgcgtggaggaggatcacagcaacaccgagctgggcatcgtggagtaccagcacgccttcaagaccccggatgcagatgccggtgaagaaagagtt

SEQ ID NO: 250 - DNA, 2265 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaagggaggaggtgggtctggaggtggaggatctggtggaggtgggtctggaggaggtgggtctcaggtgcagctgcaggagtcgggcccaggactggtgaagccttcggagaccctgtccctcacctgcactgtctctggtggctccgtcagcagtggtgattactactggacctggatccggcagtccccagggaagggactggagtggattggacacatctattacagtgggaacaccaattataacccctccctcaagagtcgactcaccatatcaattgacacgtccaagactcagttctccctgaagctgagttctgtgaccgctgcggacacggccatttattactgtgtgcgagatcgagtgactggtgcttttgatatctggggccaagggacaatggtcaccgtctcttcagcctccaccaagggcccatcggtcttccccctggcgccctgctccaggagcacctccgagagcacagcggccctgggctgcctggtcaaggactacttccctgaaccggtgacggtgtcgtggaactcaggcgctctgaccagcggcgtgcacaccttcccggctgtcctacagtcctcaggactctactccctcagcagcgtggtgaccgtgccctccagcaacttcggcacccagacctacacctgcaacgtagatcacaagcccagcaataccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttccaaagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggt

SEQ ID NO: 251 - DNA, 2253 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaagggaggaggtgggtctggaggaggtgggtctggaggtggaggatctggtggaggtgggtctcaggttcagctggtgcagtctggtgctgaggtgaagaagcctggtgcctcagtgaaggtctcctgcaaggcttctggttacacattcactgactactacatgcactgggtgcgtcaggcccctggtcaaggtcttgagtggatgggtcgtgttaatcctaaccggaggggtactacctacaaccagaaattcgagggccgtgtcaccatgaccacagacacatccacgagcacagcctacatggagctgcgtagcctgcgttctgacgacacggccgtgtattactgtgcgcgtgcgaactggcttgactactggggccagggcaccaccgtcaccgtctcctccgcctccaccaagggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctg

SEQ ID NO: 252 - DNA, 1710 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaagggaggaggtgggtctggaggtggaggatctggtggaggtgggtctggaggaggtgggtctcaggtgcagctggtgcagagcggcgccgaggacaagaagcccggcgagagcgtgaagatcagctgcaaggccagcggctacaccttcaccaactacggcatgaactgggtgaggcaggcccccggccagggcctgaagtggatgggctggatcaacacctacaccggcgagagcacctacgccgacgacttcaagggcaggttcgccttcagcctggacaccagcgccagcaccgcctacctgcagctgagcagcctgaggggcgaggacaccgccgtgtacttctgcgccaggttcgccatcaagggcgactactggggccagggcaccaccgtgaccgtgagcagcgccagcaccggcggcggcggcagcggcggcggcggcagcggcggcggcggcagcggcggcggcggcagcgacatcgtgatgacccagagccccctgagcctggaggtgagccccggcgagcccgccagcatcagctgcaggagcaccaagagcctgctgcacagcgacggcatcacctacctgtactggtacctgcagaagcccggccagagcccccagctgctgatctaccagctgagcaacctggccagcggcgtgcccgacaggttcagcagcagcggcagcggcaccgacttcaccctgaagatcagcagggtggaggccgaggacgagggcacctactactgcgcccagaacctggagatccccaggaccttcggccagggcaccaagctggagatcaagaggacccatcatcaccatcaccat

SEQ ID NO: 253 - DNA, 1695 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaagggaggaggtgggtctggaggtggaggatctggtggaggtgggtctggaggaggtgggtctcaggttcagctggtgcagtctggtgctgaggatgtgaagcctgatgcctcagtgaagctctcctgcaaggcttctggttacacattcactgactactacatgcactgggtgcgtcaggcccctggtcaaggtcttgagtggatgggtcgtgttaatcctaaccggaggggtactacctacaaccagaaattcgagggccgtgtcaccatgaccacagacacatccacgagcacagcctacatgcagctgagtagcctgcgtggtgaagacacggccgtgtattactgtgcgcgtgcgaactggcttgactactggggccagggcaccaccgtcaccgtctcctccgcctccaccgggggaggtgggtctggaggtggaggatctggtggaggtgggtctggtggaggtgggtctgacatccagatgacccagtctccatcctccctggaggcatctgtaggagacagagtcaccatcacttgcagtgtcagctcaagtgtatcctccatttacttgcactggtatcagcagaaaccagggaaaagccctaagctcctgatctatagcacatccaacttggcttctggagtcccagataggttcagtggcagtggatctgggacagatttcactctcaccatcagcagtctgcaagccgaagatgagggcacttactactgtcaagtctacagtggttacccgctcacgttcggcggagggaccaagctggagatcaaacgaactcatcatcaccatcaccat

SEQ ID NO: 254 - DNA, 1704 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaagggaggaggtgggtctggaggtggaggatctggtggaggtgggtctggaggaggtgggtctcaggtgcagctgcaggagagcggccccggcgacgtgaagcccagcgagaccctgagcctgacctgcaccgtgagcggcggcagcgtgagcagcggcgactactactggacctggatcaggcagagccccggcaagggcctggagtggatcggccacatctactacagcggcaacaccaactacaaccccagcctgaagagcaggctgaccatcagcatcgacaccagcaagaccaccttcagcctgcagctgagcagcgtgaccggcgaggacaccgccatctactactgcgtgagggacagggtgaccggcgccttcgacatctggggccagggcaccaccgtgaccgtgagcagcgccagcaccggcggcggcggcagcggcggcggcggcagcggcggcggcggcagcggcggcggcggcagcgacatccagatgacccagagccccagcagcctggaggccagcgtgggcgacagggtgaccatcacctgccaggccagccaggacatcagcaactacctgaactggtaccagcagaagcccggcaagagccccaagctgctgatctacgacgccagcaacctggagaccggcgtgcccgacaggttcagcggcagcggcagcggcaccgacttcaccttcaccatcagcagcctgcaggccgaggacgagggcacctacttctgccagcacttcgaccacctgcccctggccttcggcggcggcaccaagctggagatcaagaggacccatcatcaccatcaccat

SEQ ID NO: 255 - DNA, 1692 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggggggaggtgggtctggaggtggaggatctggtggaggtgggtctggtggaggtgggtctgaggtgcagctggtggagtctggtggtggtcttgttcaacctggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacctggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacgcatcatcaccatcaccat

SEQ ID NO: 256 - DNA, 2352 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtggaggaggtgggtctggaggtggaggatctggtggaggtgggtctggaggaggtgggtctgaggtgcagctggtggagtctggtggtggtcttgttcaacctggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacctggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacg

SEQ ID NO: 257 - DNA, 2787 bp, Artificial Sequence
  Description of Artificial Sequence: Synthetic polynucleotide
atggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgggaggaggtgggtctggaggtggaggatctggtggaggtgggtctggaggaggtgggtctcaggtgcagctgcaggagagcggccccggcgacgtgaagcccagcgagaccctgagcctgacctgcaccgtgagcggcggcagcgtgagcagcggcgactactactggacctggatcaggcagagccccggcaagggcctggagtggatcggccacatctactacagcggcaacaccaactacaaccccagcctgaagagcaggctgaccatcagcatcgacaccagcaagaccaccttcagcctgcagctgagcagcgtgaccggcgaggacaccgccatctactactgcgtgagggacagggtgaccggcgccttcgacatctggggccagggcaccaccgtgaccgtgagcagcgccagcaccggcggcggcggcagcggcggcggcggcagcggcggcggcggcagcggcggcggcggcagcgacatccagatgacccagagccccagcagcctggaggccagcgtgggcgacagggtgaccatcacctgccaggccagccaggacatcagcaactacctgaactggtaccagcagaagcccggcaagagccccaagctgctgatctacgacgccagcaacctggagaccggcgtgcccgacaggttcagcggcagcggcagcggcaccgacttcaccttcaccatcagcagcctgcaggccgaggacgagggcacctacttctgccagcacttcgaccacctgcccctggccttcggcggcggcaccaagctggagatcaagaggacccatcatcaccatcaccat

SEQ ID NO: 258 - DNA, 1362 bp, Artificial Sequence
  Description of Artificial Sequence: Synthetic polynucleotide
atggagctggcggccttgtgccgctgggggctcctcctcgccctcttgccccccggagccgcgagcaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgggaggaggtgggtctggaggtggaggatctggtggaggtgggtctggaggaggtgggtctcaggtgcagctgcaggagagcggccccggcgacgtgaagcccagcgagaccctgagcctgacctgcaccgtgagcggcggcagcgtgagcagcggcgactactactggacctggatcaggcagagccccggcaagggcctggagtggatcggccacatctactacagcggcaacaccaactacaaccccagcctgaagagcaggctgaccatcagcatcgacaccagcaagaccaccttcagcctgcagctgagcagcgtgaccggcgaggacaccgccatctactactgcgtgagggacagggtgaccggcgccttcgacatctggggccagggcaccaccgtgaccgtgagcagcgccagcaccggcggcggcggcagcggcggcggcggcagcggcggcggcggcagcggcggcggcggcagcgacatccagatgacccagagccccagcagcctggaggccagcgtgggcgacagggtgaccatcacctgccaggccagccaggacatcagcaactacctgaactggtaccagcagaagcccggcaagagccccaagctgctgatctacgacgccagcaacctggagaccggcgtgcccgacaggttcagcggcagcggcagcggcaccgacttcaccttcaccatcagcagcctgcaggccgaggacgagggcacctacttctgccagcacttcgaccacctgcccctggccttcggcggcggcaccaagctggagatcaagaggacccatcatcaccatcaccat

SEQ ID NO: 259-262 - skipped (4 entries)

SEQ ID NO: 263 - DNA, 1689 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaagggaggaggtgggtctggaggtggaggatctggtggaggtgggtctggaggaggtgggtctgaggtgcagctgcagcagtctggggctgagctggtgaagcctggggcctcagtgaagatgtcctgcaaggcttctggctacacatttaccagttacaatatgcactgggtaaagcagacacctggacagggcctggaatggattggagctatttatccaggaaatggtgatacttcctacaatcagaagttcaaaggcaaggccacattgactgcagacaaatcctccagcacagcctacatgcagctcagcagcctgacatctgaggactctgcggactattactgtgcaagatctaattattacggtagtagctactggttcttcgatgtctggggcgcagggaccacggtcaccgtctcctcaggcagtactagcggtggtggctccgggggcggttccggtgggggcggcagcagcgacattgtgctgacccaatctccagctatcctgtctgcatctccaggggagaaggtcacaatgacttgcagggccagctcaagtgtaaattacatggactggtaccagaagaagccaggatcctcccccaaaccctggatttatgccacatccaacctggcttctggagtccctgctcgcttcagtggcagtgggtctgggacctcttactctctcacaatcagcagagtggaggctgaagatgctgccacttattactgccagcagtggagttttaatccacccacgttcggaggggggaccaagctggaaataaaacatcatcaccatcaccat

SEQ ID NO: 264 - DNA, 1815 bp, Artificial Sequence
  Description of Artificial Sequence: Synthetic polynucleotide
atgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataaggcctgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaggaggaggtgggtctggaggtggaggatctggtggaggtgggtctggaggaggtgggtctgacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggactaagttggaaataacaggaggaggtgggtctggaggtggaggatctggtggaggtgggtctggaggaggtgggtctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacatcatcaccatcaccat

SEQ ID NO: 265 - DNA, 1812 bp, Artificial Sequence
  Description of Artificial Sequence: Synthetic polynucleotide
atgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataaggcctgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaggaggaggtgggtctggaggtggaggatctggtggaggtgggtctggaggaggtgggtctgaggtgcagctgcagcagtctggggctgagctggtgaagcctggggcctcagtgaagatgtcctgcaaggcttctggctacacatttaccagttacaatatgcactgggtaaagcagacacctggacagggcctggaatggattggagctatttatccaggaaatggtgatacttcctacaatcagaagttcaaaggcaaggccacattgactgcagacaaatcctccagcacagcctacatgcagctcagcagcctgacatctgaggactctgcggactattactgtgcaagatctaattattacggtagtagctactggttcttcgatgtctggggcgcagggaccacggtcaccgtctcctcaggcagtactagcggtggtggctccgggggcggttccggtgggggcggcagcagcgacattgtgctgacccaatctccagctatcctgtctgcatctccaggggagaaggtcacaatgacttgcagggccagctcaagtgtaaattacatggactggtaccagaagaagccaggatcctcccccaaaccctggatttatgccacatccaacctggcttctggagtccctgctcgcttcagtggcagtgggtctgggacctcttactctctcacaatcagcagagtggaggctgaagatgctgccacttattactgccagcagtggagttttaatccacccacgttcggaggggggaccaagctggaaataaaacatcatcaccatcaccat

SEQ ID NO: 266 - DNA, 1340 bp, Artificial Sequence
  Description of Artificial Sequence: Synthetic polynucleotide
aagcttgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcaagcttaactagttagcggaccgacgcgtacgcggccgctcgagatggagagcgacgagagcggcctgcccgccatggagatcgagtgccgcatcaccggcaccctgaacggcgtggagttcgagctggtgggcggcggagagggcacccccgagcagggccgcatgaccaacaagatgaagagcaccaaaggcgccctgaccttcagcccctacctgctgagccacgtgatgggctacggcttctaccacttcggcacctaccccagcggctacgagaaccccttcctgcacgccatcaacaacggcggctacaccaacacccgcatcgagaagtacgaggacggcggcgtgctgcacgtgagcttcagctaccgctacgaggccggccgcgtgatcggcgacttcaaggtgatgggcaccggcttccccgaggacagcgtgatcttcaccgacaagatcatccgcagcaacgccaccgtggagcacctgcaccccatgggcgataacgatctggatggcagcttcacccgcaccttcagcctgcgcgacggcggctactacagctccgtggtggacagccacatgcacttcaagagcgccatccaccccagcatcctgcagaacgggggccccatgttcgccttccgccgcgtggaggaggatcacagcaacaccgagctgggcatcgtggagtaccagcacgccttcaagaccccggatgcagatgccggtgaagaaagagtt

SEQ ID NO: 267 - DNA, 1737 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaagggaggaggtgggtctggaggtggaggatctggtggaggtgggtctggaggaggtgggtctgacatcctgatgacccaatctccatcctccatgtctgtatctctgggagacacagtcagcatcacttgccattcaagtcaggacattaacagtaatatagggtggttgcagcagagaccagggaaatcatttaagggcctgatctatcatggaaccaacttggacgatgaagttccatcaaggttcagtggcagtggatctggagccgattattctctcaccatcagcagcctggaatctgaagattttgcagactattactgtgtacagtatgctcagtttccgtggacgttcggtggaggcaccaagctcgaaatcaaacgtggaggaggtgggtctggaggtggaggatctggtggaggtgggtctggaggaggtgggtctatgagagtgctgattcttttgtggctgttcacagcctttcctggtgtcctgtctgatgtgcagcttcaggagtcgggacctagcctggtgaaaccttctcagtctctgtccctcacctgcactgtcactggctactcaatcaccagtgattttgcctggaactggatccggcagtttccaggaaacaagctggagtggatgggctacataagttatagtggtaacactaggtacaacccatctctcaaaagtcgaatctctatcactcgagacacatccaagaaccaattcttcctgcagttgaattctgtgactattgaggacacagccacatattactgtgtaacggcgggacgcgggtttccttattggggccaagggactctggtcactgtctctgcacatcatcaccatcaccat

SEQ ID NO: 268 - DNA, 1860 bp, Artificial Sequence
  Description of Artificial Sequence: Synthetic polynucleotide
atgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataaggcctgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaggaggaggtgggtctggaggtggaggatctggtggaggtgggtctggaggaggtgggtctgacatcctgatgacccaatctccatcctccatgtctgtatctctgggagacacagtcagcatcacttgccattcaagtcaggacattaacagtaatatagggtggttgcagcagagaccagggaaatcatttaagggcctgatctatcatggaaccaacttggacgatgaagttccatcaaggttcagtggcagtggatctggagccgattattctctcaccatcagcagcctggaatctgaagattttgcagactattactgtgtacagtatgctcagtttccgtggacgttcggtggaggcaccaagctcgaaatcaaacgtggaggaggtgggtctggaggtggaggatctggtggaggtgggtctggaggaggtgggtctatgagagtgctgattcttttgtggctgttcacagcctttcctggtgtcctgtctgatgtgcagcttcaggagtcgggacctagcctggtgaaaccttctcagtctctgtccctcacctgcactgtcactggctactcaatcaccagtgattttgcctggaactggatccggcagtttccaggaaacaagctggagtggatgggctacataagttatagtggtaacactaggtacaacccatctctcaaaagtcgaatctctatcactcgagacacatccaagaaccaattcttcctgcagttgaattctgtgactattgaggacacagccacatattactgtgtaacggcgggacgcgggtttccttattggggccaagggactctggtcactgtctctgcacatcatcaccatcaccat

SEQ ID NO: 269-270 - skipped (2 entries)

SEQ ID NO: 271 - DNA, 1605 bp, Artificial Sequence
  Description of Artificial Sequence: Synthetic polynucleotide
atgctcaggctgctcttggctctcaacttattcccttcaattcaagtaacaggagacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggactaagttggaaataacaggaggaggtgggtctggaggtggaggatctggtggaggtgggtctggaggaggtgggtctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcagactacaaagacgatgacgacaagattgaagttatgtatcctcctccttacctagacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 272 - DNA, 1605 bp, Artificial Sequence; identical to SEQ ID NO: 271
  Description of Artificial Sequence: Synthetic polynucleotide

SEQ ID NO: 273 - DNA, 2232 bp, Artificial Sequence
  Description of Artificial Sequence: Synthetic polynucleotide
tattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgcggccgcgccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacttggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagggggaggtgggtctggaggtggaggatctggtggaggtgggtctggtggaggtgggtctgaggtgcagctggtggagtctggtggtggtcttgttcaacccggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacccggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacgcatcatcaccatcaccat

SEQ ID NO: 274 - DNA, 2434 bp, Artificial Sequence
  Description of Artificial Sequence: Synthetic polynucleotide
gggagaagctagacttaaaatcttccattgcagctgtaaacacatctggacaatagtctgttttctgcatttgtgaatcccacacccatggaactatgaatcgtgcatcagagttatttaaaaccaccgtgcatggagtgaaccaataccgaggtgtttgcttatcattttcctttgagcacacagcacagccttgaactcagtgacactcctaagagggctctagggtcaggccaacttagatgagatgctagtctttagctaaagatgcccttccacccccgttgcacgaccttgcttctcagtctttgttgagtcttctgggggagaatccccctagaggactcagtttacaaaaccctaagtgagaccactgccaagaagtgcttgctcacccctcctgccgcggcagggaatccccctttccttgtacaggcaaaacacaaaaaaggactcataagtgaagcctgatccttctcaccaaacactgcccacacctcctagtaattgaacttgaaaaaaaaaactggtttgaaaaattaccgcaaaccatattgtcataaaaaaaaaaaaaaacacttcctatatgagatcacagaacagagtaggcacaagttcctgctgagcagatcagcctaatgcttaaatagaacaactcctggctgtcattgacattgtctaaaagccaagatgacagactgagaggcctgagcccttgttctggcattctcccaggaagatgcagtaaaggggttgacccaatatacgcggccgcgccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacttggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagggggaggtgggtctggaggtggaggatctggtggaggtgggtctggtggaggtgggtctgaggtgcagctggtggagtctggtggtggtcttgttcaacccggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacccggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacgcatcatcaccatcaccat

SEQ ID NO: 275 - DNA, 1998 bp, Artificial Sequence
  Description of Artificial Sequence: Synthetic polynucleotide
aatttaaggcaggatgtctcagagtctgggaaaatcccactttcctcctgctacaccttacagttgtgagaaagcacatttcagacaacagggaaaacccatacttcaccacaacaacacactatacattgtctggtccactggagcataaattaaagagaaacaatgtagtcaagcaagtaggcggcaagaggaagggggcggagacatcatcagggagtataaactctgagatgcctcagagcctcacagactcaacaagagctccagcaaagactttcactgtagcttgacttgacctgagattaactagggaatcttgagaataaaggcggccgcgccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacttggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagggggaggtgggtctggaggtggaggatctggtggaggtgggtctggtggaggtgggtctgaggtgcagctggtggagtctggtggtggtcttgttcaacccggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacccggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacgcatcatcaccatcaccat

SEQ ID NO: 276 - DNA, 2705 bp, Artificial Sequence
  Description of Artificial Sequence: Synthetic polynucleotide
taacgaagacagggccatgtagagggccccagggagtgaaagggcctccaggacctccaggtatggaatacaggggacgtttaagaagatatggccacacactggggccctgagaagtgagagcttcatgaaaaaaatcagggaccccagagttccttggaagccaagactgaaaccagcattatgagtctccgggtcagaatgaaagaagaaggcctgccccagtggggtctgtgaattcccgggggtgatttcactccccggggctgtcccaggcttgtccctgctacccccacccagcctttcctgaggcctcaagcctgccaccaagcccccagctccttctccccgcagggacccaaacacaggcctcgggactcaacacagcttttccctccaaccccgttttctctccctcaaggactcagctttctgaggcccctcccagttctagttctatctttttcctgcatcctgtctggaagttagaaggaaacagaccacagacccggtccccaaaagaaatggaggcaataggttttgaggggcatggggacggggttcagcctccagggtcctacacacaaatcagtcagtggcccagaagaccccctcggaatcggagcagggaggatggggagtgtgaggggtatccttgatgcttgtgtgtccccaactttccaaatccccgcccccgcgatggagaagaaaccgagacagaaggtgcagggcccactaccgcttcctccagatgagctcatgggtttctccaccaaggaagttttccgctggttgaatgattctttccccgccctcctctcgccccagggacatataaaggcagttgttggcacacccagccagcagacgctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacacgcggccgcgccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacttggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagggggaggtgggtctggaggtggaggatctggtggaggtgggtctggtggaggtgggtctgaggtgcagctggtggagtctggtggtggtcttgttcaacccggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacccggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacgcatcatcaccatcaccat

SEQ ID NO: 277 - DNA, 2030 bp, Artificial Sequence
  Description of Artificial Sequence: Synthetic polynucleotide
gatatcgaattaggaggaaaactgtttcatacagaaggcgtcaattaggaggaaaaactgtttcatacagaaggcgtcaattaggaggaaaaactgtttcatacagaaggcgtcaattggtcccatcgaattaggaggaaaaactgtttcatacagaaggcgtcaattaggaggaaaaactgtttcatacagaaggcgtcaattaggaggaaaaactgtttcatacagaaggcgtcaattggtcccgggacattttgacacccccataatatttttccagaattaacagtataaattgcatctcttgttcaagagttccctatcactctctttaatcactactcacagtaacctcaactcctggcggccgcgccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacttggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagggggaggtgggtctggaggtggaggatctggtggaggtgggtctggtggaggtgggtctgaggtgcagctggtggagtctggtggtggtcttgttcaacccggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacccggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacgcatcatcaccatcaccat

SEQ ID NO: 278 - DNA, 1515 bp, Artificial Sequence
  Description of Artificial Sequence: Synthetic polynucleotide
atggattttcaggtgcagattttcagcttcctgctaatcagtgcctcagtcataatgtctagaatggcccaggtcaaactacaggagtcaggggctgagctggtgaagcctggggcctcagtgaagatgtcctgcaaggcttctggctacacatttaccagttacaatatgcactgggtaaagcagacacctggacagggcctggaatggattggagctatttatccaggaaatggtgatacttcctacaatcagaagttcaaaggcaaggccacattgactgcagacaaatcctccagcacagcctacatgcagctcagcagcctgacatctgaggactctgcggactattactgtgcaagatctaattattacggtagtagctactggttcttcgatgtctggggccaagggaccacggtcaccgtctcctcaggtggaggcggttcaggcggaggtggctctggcggtggcggatcggacatcgagctcactcagtctccaacaatcctgtctgcatctccaggggagaaggtcacaatgacttgcagggccagctcaagtgtaaattacatggactggtaccagaagaagccaggatcctcccccaaaccctggatttatgccacatccaacctggcttctggagtccctgctcgcttcagtggcagtgggtctgggacctcttactctctcacaatcagcagagtggaggctgaagatgctgccacttattactgccagcagtggagttttaatccacccacgttcggaggggggacaaagttggaaataaaacgggccgccgctggtgatcccgccgagcccaaatctcctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggt

SEQ ID NO: 279 - DNA, 828 bp, Artificial Sequence
  Description of Artificial Sequence: Synthetic polynucleotide
atggattttcaggtgcagattttcagcttcctgctaatcagtgcctcagtcataatgtctagaatggcccaggtcaaactacaggagtcaggggctgagctggtgaagcctggggcctcagtgaagatgtcctgcaaggcttctggctacacatttaccagttacaatatgcactgggtaaagcagacacctggacagggcctggaatggattggagctatttatccaggaaatggtgatacttcctacaatcagaagttcaaaggcaaggccacattgactgcagacaaatcctccagcacagcctacatgcagctcagcagcctgacatctgaggactctgcggactattactgtgcaagatctaattattacggtagtagctactggttcttcgatgtctggggccaagggaccacggtcaccgtctcctcaggtggaggcggttcaggcggaggtggctctggcggtggcggatcggacatcgagctcactcagtctccaacaatcctgtctgcatctccaggggagaaggtcacaatgacttgcagggccagctcaagtgtaaattacatggactggtaccagaagaagccaggatcctcccccaaaccctggatttatgccacatccaacctggcttctggagtccctgctcgcttcagtggcagtgggtctgggacctcttactctctcacaatcagcagagtggaggctgaagatgctgccacttattactgccagcagtggagttttaatccacccacgttcggaggggggacaaagttggaaataaaacgggccgccgctcatcatcaccatcaccat

SEQ ID NO: 280 - DNA, 1515 bp, Artificial Sequence
  Description of Artificial Sequence: Synthetic polynucleotide
atggattttcaggtgcagattttcagcttcctgctaatcagtgcctcagtcataatgtctagagacatcgagctcactcagtctccaacaatcctgtctgcatctccaggggagaaggtcacaatgacttgcagggccagctcaagtgtaaattacatggactggtaccagaagaagccaggatcctcccccaaaccctggatttatgccacatccaacctggcttctggagtccctgctcgcttcagtggcagtgggtctgggacctcttactctctcacaatcagcagagtggaggctgaagatgctgccacttattactgccagcagtggagttttaatccacccacgttcggaggggggacaaagttggaaataaaacggggtggaggcggttcaggcggaggtggctctggcggtggcggatcgatggcccaggtcaaactacaggagtcaggggctgagctggtgaagcctggggcctcagtgaagatgtcctgcaaggcttctggctacacatttaccagttacaatatgcactgggtaaagcagacacctggacagggcctggaatggattggagctatttatccaggaaatggtgatacttcctacaatcagaagttcaaaggcaaggccacattgactgcagacaaatcctccagcacagcctacatgcagctcagcagcctgacatctgaggactctgcggactattactgtgcaagatctaattattacggtagtagctactggttcttcgatgtctggggccaagggaccacggtcaccgtctcctcagccgccgctggtgatcccgccgagcccaaatctcctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggt

SEQ ID NO: 281 - DNA, 828 bp, Artificial Sequence
  Description of Artificial Sequence: Synthetic polynucleotide
atggattttcaggtgcagattttcagcttcctgctaatcagtgcctcagtcataatgtctagagacatcgagctcactcagtctccaacaatcctgtctgcatctccaggggagaaggtcacaatgacttgcagggccagctcaagtgtaaattacatggactggtaccagaagaagccaggatcctcccccaaaccctggatttatgccacatccaacctggcttctggagtccctgctcgcttcagtggcagtgggtctgggacctcttactctctcacaatcagcagagtggaggctgaagatgctgccacttattactgccagcagtggagttttaatccacccacgttcggaggggggacaaagttggaaataaaacggggtggaggcggttcaggcggaggtggctctggcggtggcggatcgatggcccaggtcaaactacaggagtcaggggctgagctggtgaagcctggggcctcagtgaagatgtcctgcaaggcttctggctacacatttaccagttacaatatgcactgggtaaagcagacacctggacagggcctggaatggattggagctatttatccaggaaatggtgatacttcctacaatcagaagttcaaaggcaaggccacattgactgcagacaaatcctccagcacagcctacatgcagctcagcagcctgacatctgaggactctgcggactattactgtgcaagatctaattattacggtagtagctactggttcttcgatgtctggggccaagggaccacggtcaccgtctcctcagccgccgctcatcatcaccatcaccat

SEQ ID NO: 282 - DNA, 2346 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccaggaggaggtgggtctggaggtggaggatctggtggaggtgggtctggaggaggtgggtctatggcccaggtcaaactacaggagtcaggggctgagctggtgaagcctggggcctcagtgaagatgtcctgcaaggcttctggctacacatttaccagttacaatatgcactgggtaaagcagacacctggacagggcctggaatggattggagctatttatccaggaaatggtgatacttcctacaatcagaagttcaaaggcaaggccacattgactgcagacaaatcctccagcacagcctacatgcagctcagcagcctgacatctgaggactctgcggactattactgtgcaagatctaattattacggtagtagctactggttcttcgatgtctggggccaagggaccacggtcaccgtctcctcaggtggaggcggttcaggcggaggtggctctggcggtggcggatcggacatcgagctcactcagtctccaacaatcctgtctgcatctccaggggagaaggtcacaatgacttgcagggccagctcaagtgtaaattacatggactggtaccagaagaagccaggatcctcccccaaaccctggatttatgccacatccaacctggcttctggagtccctgctcgcttcagtggcagtgggtctgggacctcttactctctcacaatcagcagagtggaggctgaagatgctgccacttattactgccagcagtggagttttaatccacccacgttcggaggggggacaaagttggaaataaaacgggccgccgctggtgatcccgccgagcccaaatctcctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggt

SEQ ID NO: 283 - DNA, 1659 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccaggaggaggtgggtctggaggtggaggatctggtggaggtgggtctggaggaggtgggtctatggcccaggtcaaactacaggagtcaggggctgagctggtgaagcctggggcctcagtgaagatgtcctgcaaggcttctggctacacatttaccagttacaatatgcactgggtaaagcagacacctggacagggcctggaatggattggagctatttatccaggaaatggtgatacttcctacaatcagaagttcaaaggcaaggccacattgactgcagacaaatcctccagcacagcctacatgcagctcagcagcctgacatctgaggactctgcggactattactgtgcaagatctaattattacggtagtagctactggttcttcgatgtctggggccaagggaccacggtcaccgtctcctcaggtggaggcggttcaggcggaggtggctctggcggtggcggatcggacatcgagctcactcagtctccaacaatcctgtctgcatctccaggggagaaggtcacaatgacttgcagggccagctcaagtgtaaattacatggactggtaccagaagaagccaggatcctcccccaaaccctggatttatgccacatccaacctggcttctggagtccctgctcgcttcagtggcagtgggtctgggacctcttactctctcacaatcagcagagtggaggctgaagatgctgccacttattactgccagcagtggagttttaatccacccacgttcggaggggggacaaagttggaaataaaacgggccgccgctcatcatcaccatcaccat

SEQ ID NO: 284 - DNA, 2346 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccaggaggaggtgggtctggaggtggaggatctggtggaggtgggtctggaggaggtgggtctgacatcgagctcactcagtctccaacaatcctgtctgcatctccaggggagaaggtcacaatgacttgcagggccagctcaagtgtaaattacatggactggtaccagaagaagccaggatcctcccccaaaccctggatttatgccacatccaacctggcttctggagtccctgctcgcttcagtggcagtgggtctgggacctcttactctctcacaatcagcagagtggaggctgaagatgctgccacttattactgccagcagtggagttttaatccacccacgttcggaggggggacaaagttggaaataaaacggggtggaggcggttcaggcggaggtggctctggcggtggcggatcgatggcccaggtcaaactacaggagtcaggggctgagctggtgaagcctggggcctcagtgaagatgtcctgcaaggcttctggctacacatttaccagttacaatatgcactgggtaaagcagacacctggacagggcctggaatggattggagctatttatccaggaaatggtgatacttcctacaatcagaagttcaaaggcaaggccacattgactgcagacaaatcctccagcacagcctacatgcagctcagcagcctgacatctgaggactctgcggactattactgtgcaagatctaattattacggtagtagctactggttcttcgatgtctggggccaagggaccacggtcaccgtctcctcagccgccgctggtgatcccgccgagcccaaatctcctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggt

SEQ ID NO: 285 - DNA, 1659 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccaggaggaggtgggtctggaggtggaggatctggtggaggtgggtctggaggaggtgggtctgacatcgagctcactcagtctccaacaatcctgtctgcatctccaggggagaaggtcacaatgacttgcagggccagctcaagtgtaaattacatggactggtaccagaagaagccaggatcctcccccaaaccctggatttatgccacatccaacctggcttctggagtccctgctcgcttcagtggcagtgggtctgggacctcttactctctcacaatcagcagagtggaggctgaagatgctgccacttattactgccagcagtggagttttaatccacccacgttcggaggggggacaaagttggaaataaaacggggtggaggcggttcaggcggaggtggctctggcggtggcggatcgatggcccaggtcaaactacaggagtcaggggctgagctggtgaagcctggggcctcagtgaagatgtcctgcaaggcttctggctacacatttaccagttacaatatgcactgggtaaagcagacacctggacagggcctggaatggattggagctatttatccaggaaatggtgatacttcctacaatcagaagttcaaaggcaaggccacattgactgcagacaaatcctccagcacagcctacatgcagctcagcagcctgacatctgaggactctgcggactattactgtgcaagatctaattattacggtagtagctactggttcttcgatgtctggggccaagggaccacggtcaccgtctcctcagccgccgctcatcatcaccatcaccat

SEQ ID NO: 286 - DNA, 1671 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccaggaggaggtgggtctggaggtggaggatctggtggaggtgggtctggaggaggtgggtctcaggtgcagctggtgcagagcggcgccgaggacaagaagcccggcgagagcgtgaagatcagctgcaaggccagcggctacaccttcaccaactacggcatgaactgggtgaggcaggcccccggccagggcctgaagtggatgggctggatcaacacctacaccggcgagagcacctacgccgacgacttcaagggcaggttcgccttcagcctggacaccagcgccagcaccgcctacctgcagctgagcagcctgaggggcgaggacaccgccgtgtacttctgcgccaggttcgccatcaagggcgactactggggccagggcaccaccgtgaccgtgagcagcgccagcaccggcggcggcggcagcggcggcggcggcagcggcggcggcggcagcggcggcggcggcagcgacatcgtgatgacccagagccccctgagcctggaggtgagccccggcgagcccgccagcatcagctgcaggagcaccaagagcctgctgcacagcgacggcatcacctacctgtactggtacctgcagaagcccggccagagcccccagctgctgatctaccagctgagcaacctggccagcggcgtgcccgacaggttcagcagcagcggcagcggcaccgacttcaccctgaagatcagcagggtggaggccgaggacgagggcacctactactgcgcccagaacctggagatccccaggaccttcggccagggcaccaagctggagatcaagaggacccatcatcaccatcaccat

SEQ ID NO: 287 - DNA, 1656 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccaggaggaggtgggtctggaggtggaggatctggtggaggtgggtctggaggaggtgggtctcaggttcagctggtgcagtctggtgctgaggatgtgaagcctgatgcctcagtgaagctctcctgcaaggcttctggttacacattcactgactactacatgcactgggtgcgtcaggcccctggtcaaggtcttgagtggatgggtcgtgttaatcctaaccggaggggtactacctacaaccagaaattcgagggccgtgtcaccatgaccacagacacatccacgagcacagcctacatgcagctgagtagcctgcgtggtgaagacacggccgtgtattactgtgcgcgtgcgaactggcttgactactggggccagggcaccaccgtcaccgtctcctccgcctccaccgggggaggtgggtctggaggtggaggatctggtggaggtgggtctggtggaggtgggtctgacatccagatgacccagtctccatcctccctggaggcatctgtaggagacagagtcaccatcacttgcagtgtcagctcaagtgtatcctccatttacttgcactggtatcagcagaaaccagggaaaagccctaagctcctgatctatagcacatccaacttggcttctggagtcccagataggttcagtggcagtggatctgggacagatttcactctcaccatcagcagtctgcaagccgaagatgagggcacttactactgtcaagtctacagtggttacccgctcacgttcggcggagggaccaagctggagatcaaacgaactcatcatcaccatcaccat

SEQ ID NO: 288 - DNA, 1665 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccaggaggaggtgggtctggaggtggaggatctggtggaggtgggtctggaggaggtgggtctcaggtgcagctgcaggagagcggccccggcgacgtgaagcccagcgagaccctgagcctgacctgcaccgtgagcggcggcagcgtgagcagcggcgactactactggacctggatcaggcagagccccggcaagggcctggagtggatcggccacatctactacagcggcaacaccaactacaaccccagcctgaagagcaggctgaccatcagcatcgacaccagcaagaccaccttcagcctgcagctgagcagcgtgaccggcgaggacaccgccatctactactgcgtgagggacagggtgaccggcgccttcgacatctggggccagggcaccaccgtgaccgtgagcagcgccagcaccggcggcggcggcagcggcggcggcggcagcggcggcggcggcagcggcggcggcggcagcgacatccagatgacccagagccccagcagcctggaggccagcgtgggcgacagggtgaccatcacctgccaggccagccaggacatcagcaactacctgaactggtaccagcagaagcccggcaagagccccaagctgctgatctacgacgccagcaacctggagaccggcgtgcccgacaggttcagcggcagcggcagcggcaccgacttcaccttcaccatcagcagcctgcaggccgaggacgagggcacctacttctgccagcacttcgaccacctgcccctggccttcggcggcggcaccaagctggagatcaagaggacccatcatcaccatcaccat

SEQ ID NO: 289 - DNA, 861 bp, Artificial Sequence
  Description of Artificial Sequence: Synthetic polynucleotide
atggagacagacacactcctgctatgggtactgctgctctgggttccaggttccactggtgacatcgtgctgacccagagcccccccagcctggccatgagcctgggcaagagggccaccatcagctgcagggccagcgagagcgtgaccatcctgggcagccacctgatccactggtaccagcagaagcccggccagccccccaccctgctgatccagctggccagcaacgtgcagaccggcgtgcccgccaggttcagcggcagcggcagcaggaccgacttcaccctgaccatcgaccccgtggaggaggacgacgtggccgtgtactactgcctgcagagcaggaccatccccaggaccttcggcggcggcaccaagctggagatcaagggcagcaccagcggcagcggcaagcccggcagcggcgagggcagcaccaagggccagatccagctggtgcagagcggccccgagctgaagaagcccggcgagaccgtgaagatcagctgcaaggccagcggctacaccttcaccgactacagcatcaactgggtgaagagggcccccggcaagggcctgaagtggatgggctggatcaacaccgagaccagggagcccgcctacgcctacgacttcaggggcaggttcgccttcagcctggagaccagcgccagcaccgcctacctgcagatcaacaacctgaagtacgaggacaccgccacctacttctgcgccctggactacagctacgccatggactactggggccagggcaccagcgtgaccgtgagcagcggaggaggtgggtctggaggtggaggatctggtggaggtgggtctcatcatcaccatcaccat

SEQ ID NO: 290 - DNA, 858 bp, Artificial Sequence
  Description of Artificial Sequence: Synthetic polynucleotide
atggagtttgggctgagctgggttttcctcgttgctctttttagaggtgtccagtgtcagatccagctggtgcagagcggccccgagctgaagaagcccggcgagaccgtgaagatcagctgcaaggccagcggctacaccttcaccgactacagcatcaactgggtgaagagggcccccggcaagggcctgaagtggatgggctggatcaacaccgagaccagggagcccgcctacgcctacgacttcaggggcaggttcgccttcagcctggagaccagcgccagcaccgcctacctgcagatcaacaacctgaagtacgaggacaccgccacctacttctgcgccctggactacagctacgccatggactactggggccagggcaccagcgtgaccgtgagcagcggcagcaccagcggcagcggcaagcccggcagcggcgagggcagcaccaagggcgacatcgtgctgacccagagcccccccagcctggccatgagcctgggcaagagggccaccatcagctgcagggccagcgagagcgtgaccatcctgggcagccacctgatccactggtaccagcagaagcccggccagccccccaccctgctgatccagctggccagcaacgtgcagaccggcgtgcccgccaggttcagcggcagcggcagcaggaccgacttcaccctgaccatcgaccccgtggaggaggacgacgtggccgtgtactactgcctgcagagcaggaccatccccaggaccttcggcggcggcaccaagctggagatcaagggaggaggtgggtctggaggtggaggatctggtggaggtgggtctcatcatcaccatcaccat

SEQ ID NO: 291 - DNA, 1695 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccaggaggaggtgggtctggaggtggaggatctggtggaggtgggtctggaggaggtgggtctgacatcgtgctgacccagagcccccccagcctggccatgagcctgggcaagagggccaccatcagctgcagggccagcgagagcgtgaccatcctgggcagccacctgatccactggtaccagcagaagcccggccagccccccaccctgctgatccagctggccagcaacgtgcagaccggcgtgcccgccaggttcagcggcagcggcagcaggaccgacttcaccctgaccatcgaccccgtggaggaggacgacgtggccgtgtactactgcctgcagagcaggaccatccccaggaccttcggcggcggcaccaagctggagatcaagggcagcaccagcggcagcggcaagcccggcagcggcgagggcagcaccaagggccagatccagctggtgcagagcggccccgagctgaagaagcccggcgagaccgtgaagatcagctgcaaggccagcggctacaccttcaccgactacagcatcaactgggtgaagagggcccccggcaagggcctgaagtggatgggctggatcaacaccgagaccagggagcccgcctacgcctacgacttcaggggcaggttcgccttcagcctggagaccagcgccagcaccgcctacctgcagatcaacaacctgaagtacgaggacaccgccacctacttctgcgccctggactacagctacgccatggactactggggccagggcaccagcgtgaccgtgagcagcggaggaggtgggtctggaggtggaggatctggtggaggtgggtctcatcatcaccatcaccat

SEQ ID NO: 292 - DNA, 1695 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccaggaggaggtgggtctggaggtggaggatctggtggaggtgggtctggaggaggtgggtctcagatccagctggtgcagagcggccccgagctgaagaagcccggcgagaccgtgaagatcagctgcaaggccagcggctacaccttcaccgactacagcatcaactgggtgaagagggcccccggcaagggcctgaagtggatgggctggatcaacaccgagaccagggagcccgcctacgcctacgacttcaggggcaggttcgccttcagcctggagaccagcgccagcaccgcctacctgcagatcaacaacctgaagtacgaggacaccgccacctacttctgcgccctggactacagctacgccatggactactggggccagggcaccagcgtgaccgtgagcagcggcagcaccagcggcagcggcaagcccggcagcggcgagggcagcaccaagggcgacatcgtgctgacccagagcccccccagcctggccatgagcctgggcaagagggccaccatcagctgcagggccagcgagagcgtgaccatcctgggcagccacctgatccactggtaccagcagaagcccggccagccccccaccctgctgatccagctggccagcaacgtgcagaccggcgtgcccgccaggttcagcggcagcggcagcaggaccgacttcaccctgaccatcgaccccgtggaggaggacgacgtggccgtgtactactgcctgcagagcaggaccatccccaggaccttcggcggcggcaccaagctggagatcaagggaggaggtgggtctggaggtggaggatctggtggaggtgggtctcatcatcaccatcaccat

SEQ ID NO: 293 - DNA, 2313 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtggaggaggtgggtctggaggtggaggatctggtggaggtgggtctggaggaggtgggtctgaggtgcagctggtggagtctggtggtggtcttgttcaacctggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacctggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacg

SEQ ID NO: 294 - DNA, 2481 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagggggaggtgggtctggaggtggaggatctggtggaggtgggtctggtggaggtgggtctgaggtgcagctggtggagtctggtggtggtcttgttcaacctggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacctggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacgggaggaggtgggtctggaggtggaggatctggtggaggtgggtctggaggaggtgggtctcaggtgcagctgcaggagagcggccccggcgacgtgaagcccagcgagaccctgagcctgacctgcaccgtgagcggcggcagcgtgagcagcggcgactactactggacctggatcaggcagagccccggcaagggcctggagtggatcggccacatctactacagcggcaacaccaactacaaccccagcctgaagagcaggctgaccatcagcatcgacaccagcaagaccaccttcagcctgcagctgagcagcgtgaccggcgaggacaccgccatctactactgcgtgagggacagggtgaccggcgccttcgacatctggggccagggcaccaccgtgaccgtgagcagcgccagcaccggcggaggtggcagcggcggaggtggcagcggcggaggtggcagcggcggaggtggcagcgacatccagatgacccagagccccagcagcctggaggccagcgtgggcgacagggtgaccatcacctgccaggccagccaggacatcagcaactacctgaactggtaccagcagaagcccggcaagagccccaagctgctgatctacgacgccagcaacctggagaccggcgtgcccgacaggttcagcggcagcggcagcggcaccgacttcaccttcaccatcagcagcctgcaggccgaggacgagggcacctacttctgccagcacttcgaccacctgcccctggccttcggcggcggcaccaagctggagatcaagaggaccggaggaggtgggtctcatcatcaccatcaccat

SEQ ID NO: 295 - DNA, 2481 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagggggaggtgggtctggaggtggaggatctggtggaggtgggtctggtggaggtgggtctgaggtgcagctggtggagtctggtggtggtcttgttcaacctggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacctggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacgggaggaggtgggtctggaggtggaggatctggtggaggtgggtctggaggaggtgggtctgacatccagatgacccagagccccagcagcctggaggccagcgtgggcgacagggtgaccatcacctgccaggccagccaggacatcagcaactacctgaactggtaccagcagaagcccggcaagagccccaagctgctgatctacgacgccagcaacctggagaccggcgtgcccgacaggttcagcggcagcggcagcggcaccgacttcaccttcaccatcagcagcctgcaggccgaggacgagggcacctacttctgccagcacttcgaccacctgcccctggccttcggcggcggcaccaagctggagatcaagaggaccggcggaggtggcagcggcggaggtggcagcggcggaggtggcagcggcggaggtggcagccaggtgcagctgcaggagagcggccccggcgacgtgaagcccagcgagaccctgagcctgacctgcaccgtgagcggcggcagcgtgagcagcggcgactactactggacctggatcaggcagagccccggcaagggcctggagtggatcggccacatctactacagcggcaacaccaactacaaccccagcctgaagagcaggctgaccatcagcatcgacaccagcaagaccaccttcagcctgcagctgagcagcgtgaccggcgaggacaccgccatctactactgcgtgagggacagggtgaccggcgccttcgacatctggggccagggcaccaccgtgaccgtgagcagcgccagcaccggaggaggtgggtctcatcatcaccatcaccat

SEQ ID NO: 296 - DNA, 1644 bp, Artificial Sequence
  Description of Artificial Sequence: Synthetic polynucleotide
atggagtttgggctgagctgggttttcctcgttgctctttttagaggtgtccagtgtgaggtgcagctggtggagtctggtggtggtcttgttcaacctggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacctggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacgggaggaggtgggtctggaggtggaggatctggtggaggtgggtctggaggaggtgggtctcaggtgcagctgcaggagagcggccccggcgacgtgaagcccagcgagaccctgagcctgacctgcaccgtgagcggcggcagcgtgagcagcggcgactactactggacctggatcaggcagagccccggcaagggcctggagtggatcggccacatctactacagcggcaacaccaactacaaccccagcctgaagagcaggctgaccatcagcatcgacaccagcaagaccaccttcagcctgcagctgagcagcgtgaccggcgaggacaccgccatctactactgcgtgagggacagggtgaccggcgccttcgacatctggggccagggcaccaccgtgaccgtgagcagcgccagcaccggcggaggtggcagcggcggaggtggcagcggcggaggtggcagcggcggaggtggcagcgacatccagatgacccagagccccagcagcctggaggccagcgtgggcgacagggtgaccatcacctgccaggccagccaggacatcagcaactacctgaactggtaccagcagaagcccggcaagagccccaagctgctgatctacgacgccagcaacctggagaccggcgtgcccgacaggttcagcggcagcggcagcggcaccgacttcaccttcaccatcagcagcctgcaggccgaggacgagggcacctacttctgccagcacttcgaccacctgcccctggccttcggcggcggcaccaagctggagatcaagaggaccggaggaggtgggtctcatcatcaccatcaccat

SEQ ID NO: 297 - DNA, 1644 bp, Artificial Sequence
  Description of Artificial Sequence: Synthetic polynucleotide
atggagtttgggctgagctgggttttcctcgttgctctttttagaggtgtccagtgtgaggtgcagctggtggagtctggtggtggtcttgttcaacctggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacctggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacgggaggaggtgggtctggaggtggaggatctggtggaggtgggtctggaggaggtgggtctgacatccagatgacccagagccccagcagcctggaggccagcgtgggcgacagggtgaccatcacctgccaggccagccaggacatcagcaactacctgaactggtaccagcagaagcccggcaagagccccaagctgctgatctacgacgccagcaacctggagaccggcgtgcccgacaggttcagcggcagcggcagcggcaccgacttcaccttcaccatcagcagcctgcaggccgaggacgagggcacctacttctgccagcacttcgaccacctgcccctggccttcggcggcggcaccaagctggagatcaagaggaccggcggaggtggcagcggcggaggtggcagcggcggaggtggcagcggcggaggtggcagccaggtgcagctgcaggagagcggccccggcgacgtgaagcccagcgagaccctgagcctgacctgcaccgtgagcggcggcagcgtgagcagcggcgactactactggacctggatcaggcagagccccggcaagggcctggagtggatcggccacatctactacagcggcaacaccaactacaaccccagcctgaagagcaggctgaccatcagcatcgacaccagcaagaccaccttcagcctgcagctgagcagcgtgaccggcgaggacaccgccatctactactgcgtgagggacagggtgaccggcgccttcgacatctggggccagggcaccaccgtgaccgtgagcagcgccagcaccggaggaggtgggtctcatcatcaccatcaccat

SEQ ID NO: 298 - DNA, 2030 bp, Artificial Sequence; identical to SEQ ID NO: 277
  Description of Artificial Sequence: Synthetic polynucleotide

SEQ ID NO: 299 - DNA, 1515 bp, Artificial Sequence; identical to SEQ ID NO: 278
  Description of Artificial Sequence: Synthetic polynucleotide

SEQ ID NO: 300 - DNA, 828 bp, Artificial Sequence; identical to SEQ ID NO: 279
  Description of Artificial Sequence: Synthetic polynucleotide

SEQ ID NO: 301 - DNA, 1515 bp, Artificial Sequence; identical to SEQ ID NO: 280
  Description of Artificial Sequence: Synthetic polynucleotide

SEQ ID NO: 302 - DNA, 828 bp, Artificial Sequence; identical to SEQ ID NO: 281
  Description of Artificial Sequence: Synthetic polynucleotide

SEQ ID NO: 303 - DNA, 1476 bp, Artificial Sequence
  Description of Artificial Sequence: Synthetic polynucleotide
atggagtttgggctgagctgggttttcctcgttgctctttttagaggtgtccagtgtgaggtgcagctggtggagtctggtggtggtcttgttcaacctggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacctggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacggacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggt

SEQ ID NO: 304 - DNA, 2391 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccaggaggaggtgggtctggaggtggaggatctggtggaggtgggtctggaggaggtgggtctggaggaggtgggtctggaggtggaggatctggtggaggtgggtctatggcccaggtcaaactacaggagtcaggggctgagctggtgaagcctggggcctcagtgaagatgtcctgcaaggcttctggctacacatttaccagttacaatatgcactgggtaaagcagacacctggacagggcctggaatggattggagctatttatccaggaaatggtgatacttcctacaatcagaagttcaaaggcaaggccacattgactgcagacaaatcctccagcacagcctacatgcagctcagcagcctgacatctgaggactctgcggactattactgtgcaagatctaattattacggtagtagctactggttcttcgatgtctggggccaagggaccacggtcaccgtctcctcaggtggaggcggttcaggcggaggtggctctggcggtggcggatcggacatcgagctcactcagtctccaacaatcctgtctgcatctccaggggagaaggtcacaatgacttgcagggccagctcaagtgtaaattacatggactggtaccagaagaagccaggatcctcccccaaaccctggatttatgccacatccaacctggcttctggagtccctgctcgcttcagtggcagtgggtctgggacctcttactctctcacaatcagcagagtggaggctgaagatgctgccacttattactgccagcagtggagttttaatccacccacgttcggaggggggacaaagttggaaataaaacgggccgccgctggtgatcccgccgagcccaaatctcctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggt

SEQ ID NO: 305 - DNA, 1704 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccaggaggaggtgggtctggaggtggaggatctggtggaggtgggtctggaggaggtgggtctggaggaggtgggtctggaggtggaggatctggtggaggtgggtctatggcccaggtcaaactacaggagtcaggggctgagctggtgaagcctggggcctcagtgaagatgtcctgcaaggcttctggctacacatttaccagttacaatatgcactgggtaaagcagacacctggacagggcctggaatggattggagctatttatccaggaaatggtgatacttcctacaatcagaagttcaaaggcaaggccacattgactgcagacaaatcctccagcacagcctacatgcagctcagcagcctgacatctgaggactctgcggactattactgtgcaagatctaattattacggtagtagctactggttcttcgatgtctggggccaagggaccacggtcaccgtctcctcaggtggaggcggttcaggcggaggtggctctggcggtggcggatcggacatcgagctcactcagtctccaacaatcctgtctgcatctccaggggagaaggtcacaatgacttgcagggccagctcaagtgtaaattacatggactggtaccagaagaagccaggatcctcccccaaaccctggatttatgccacatccaacctggcttctggagtccctgctcgcttcagtggcagtgggtctgggacctcttactctctcacaatcagcagagtggaggctgaagatgctgccacttattactgccagcagtggagttttaatccacccacgttcggaggggggacaaagttggaaataaaacgggccgccgctcatcatcaccatcaccat

SEQ ID NO: 306 - DNA, 2337 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagatcccgccgagcccaaatctcctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtggaggaggtgggtctggaggtggaggatctggtggaggtgggtctggaggaggtgggtctatggcccaggtcaaactacaggagtcaggggctgagctggtgaagcctggggcctcagtgaagatgtcctgcaaggcttctggctacacatttaccagttacaatatgcactgggtaaagcagacacctggacagggcctggaatggattggagctatttatccaggaaatggtgatacttcctacaatcagaagttcaaaggcaaggccacattgactgcagacaaatcctccagcacagcctacatgcagctcagcagcctgacatctgaggactctgcggactattactgtgcaagatctaattattacggtagtagctactggttcttcgatgtctggggccaagggaccacggtcaccgtctcctcaggtggaggcggttcaggcggaggtggctctggcggtggcggatcggacatcgagctcactcagtctccaacaatcctgtctgcatctccaggggagaaggtcacaatgacttgcagggccagctcaagtgtaaattacatggactggtaccagaagaagccaggatcctcccccaaaccctggatttatgccacatccaacctggcttctggagtccctgctcgcttcagtggcagtgggtctgggacctcttactctctcacaatcagcagagtggaggctgaagatgctgccacttattactgccagcagtggagttttaatccacccacgttcggaggggggacaaagttggaaataaaacgggct

SEQ ID NO: 307 - DNA, 2349 bp, Artificial Sequence
  Description of Artificial Sequence: Synthetic polynucleotide
atggattttcaggtgcagattttcagcttcctgctaatcagtgcctcagtcataatgtctagaatggcccaggtcaaactacaggagtcaggggctgagctggtgaagcctggggcctcagtgaagatgtcctgcaaggcttctggctacacatttaccagttacaatatgcactgggtaaagcagacacctggacagggcctggaatggattggagctatttatccaggaaatggtgatacttcctacaatcagaagttcaaaggcaaggccacattgactgcagacaaatcctccagcacagcctacatgcagctcagcagcctgacatctgaggactctgcggactattactgtgcaagatctaattattacggtagtagctactggttcttcgatgtctggggccaagggaccacggtcaccgtctcctcaggtggaggcggttcaggcggaggtggctctggcggtggcggatcggacatcgagctcactcagtctccaacaatcctgtctgcatctccaggggagaaggtcacaatgacttgcagggccagctcaagtgtaaattacatggactggtaccagaagaagccaggatcctcccccaaaccctggatttatgccacatccaacctggcttctggagtccctgctcgcttcagtggcagtgggtctgggacctcttactctctcacaatcagcagagtggaggctgaagatgctgccacttattactgccagcagtggagttttaatccacccacgttcggaggggggacaaagttggaaataaaacgggccgccgctggaggaggtgggtctggaggtggaggatctggtggaggtgggtctggaggaggtgggtctcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagatcccgccgagcccaaatctcctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggt

SEQ ID NO: 308 - DNA, 3318 bp, Artificial Sequence
  Description of Artificial Sequence: Synthetic polynucleotide
atgctcaggctgctcttggctctcaacttattcccttcaattcaagtaacaggagacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggactaagttggaaataacaggaggaggtgggtctggaggtggaggatctggtggaggtgggtctggaggaggtgggtctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcagactacaaagacgatgacgacaagattgaagttatgtatcctcctccttacctagacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagggggaggtgggtctggaggtggaggatctggtggaggtgggtctggtggaggtgggtctgaggtgcagctggtggagtctggtggtggtcttgttcaacctggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacctggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacgtctagacatcatcaccatcaccat

SEQ ID NO: 309 - DNA, 3318 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagggggaggtgggtctggaggtggaggatctggtggaggtgggtctggtggaggtgggtctgaggtgcagctggtggagtctggtggtggtcttgttcaacctggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacctggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacgtctagacatcatcaccatcaccatgagggcagaggaagtcttctaacatgcggtgacgtggaggagaatcccggccctatgctcaggctgctcttggctctcaacttattcccttcaattcaagtaacaggagacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggactaagttggaaataacaggaggaggtgggtctggaggtggaggatctggtggaggtgggtctggaggaggtgggtctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcagactacaaagacgatgacgacaagattgaagttatgtatcctcctccttacctagacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 310 - DNA, 2030 bp, Artificial Sequence; identical to SEQ ID NO: 277
  Description of Artificial Sequence: Synthetic polynucleotide

SEQ ID NO: 311 - DNA, 1653 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagggggaggtgggtctggaggtggaggatctggtggaggtgggtctggtggaggtgggtctgaggtgcagctggtggagtctggtggtggtcttgttcaacctggtggttctcttcgtctttcttgtgctgcttctggttttaatattaaagatacttatattcattgggttcgtcaagctcctggtaaaggtcttgaatgggttgctcgtatttatcctactaatggttatactcgttatgctgattctgttaaaggtcgttttactatttctgctgatacttctaaaaatactgcttatcttcaaatgaactctcttcgtgctgaagatactgctgtttattattgttctcgttggggtggtgatggtttttatgctatggattattggggtcaaggtactcttgtcaccgtctcctcagctagcaccgggggaggtgggtctggaggtggaggatctggtggaggtgggtctgacatccagatgacccagtctccttcttctctttctgcttctgttggtgatcgtgttactattacttgtcgtgcttctcaagatgttaatactgctgttgcttggtatcaacaaaaacctggtaaagctcctaaacttcttatttattctgcttcttttctttattctggtgttccttctcgtttttctggttctcgttctggtactgattttactcttactatttcttctcttcaacctgaagattttgctacttattattgtcaacaacattatactactcctcctacttttggtcaaggtaccaaggtggagatcaaacgtacgcaccaccatcaccaccat

SEQ ID NO: 312 - DNA, 873 bp, Artificial Sequence
  Description of Artificial Sequence: Synthetic polynucleotide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaag

SEQ ID NO: 313 - protein, 6 aa, Artificial Sequence
  Description of Artificial Sequence: Synthetic 6xHis tag
HHHHHH

What is claimed is:

1. A T-cell comprising a constitutive expression construct encoding a secreted fusion protein comprising (a) an antibody, or antigen-binding fragment thereof, that binds a tumor antigen; and (b) an extracellular domain of CD19, or a fragment thereof, that includes an epitope recognized by the FMC63 anti-CD19 antibody.

2. The T-cell of claim 1, wherein the tumor antigen is HER-2/neu, c-met, EGFR, Ga733\EpCAM, CD20, ROR1, or BCMA.

3. The T-cell of claim 1, wherein the antigen-binding fragment is an Fab, scFv, Fv, or VHH.

4. The T-cell of claim 1, wherein the T-cell is a CAR-T cell.

* * * * *